(12) United States Patent
Eichhorn et al.

(10) Patent No.: US 10,472,655 B2
(45) Date of Patent: Nov. 12, 2019

(54) ENZYMES AND APPLICATIONS THEREOF

(71) Applicant: Givaudan SA, Vernier (CH)

(72) Inventors: Eric Eichhorn, Zurich (CH); Boris Schilling, Knonau (CH); Denis Wahler, Toulouse (FR); Laurent Fourage, Suresnes (FR); Esther Locher, Duebendorf (CH)

(73) Assignee: GIVAUDAN S.A., Vernier (CH)

( * ) Notice: Subject to any disclaimer, the term of this patent is extended or adjusted under 35 U.S.C. 154(b) by 0 days.

(21) Appl. No.: 15/568,945

(22) PCT Filed: Apr. 22, 2016

(86) PCT No.: PCT/EP2016/058987
§ 371 (c)(1),
(2) Date: Oct. 24, 2017

(87) PCT Pub. No.: WO2016/170099
PCT Pub. Date: Oct. 27, 2016

(65) Prior Publication Data
US 2018/0148751 A1 May 31, 2018

(30) Foreign Application Priority Data
Apr. 24, 2015 (GB) .................... 1507207.7

(51) Int. Cl.
*C12P 17/04* (2006.01)
*C07D 307/92* (2006.01)
*C12N 9/90* (2006.01)

(52) U.S. Cl.
CPC ............ *C12P 17/04* (2013.01); *C07D 307/92* (2013.01); *C12N 9/90* (2013.01)

(58) Field of Classification Search
CPC ............................... C07D 307/92; C12P 17/04
See application file for complete search history.

(56) References Cited

U.S. PATENT DOCUMENTS

| | | | |
|---|---|---|---|
| 6,524,831 B2 | 2/2003 | Steinbüchel et al. | |
| 8,759,043 B2 | 6/2014 | Breuer et al. | |
| 8,932,839 B2 * | 1/2015 | Breuer ...................... | C12N 9/88 435/155 |
| 9,493,385 B2 * | 11/2016 | Weingarten ............. | C07C 29/58 |
| 2003/0092143 A1 | 5/2003 | Rabenhorst et al. | |
| 2009/0117557 A1 | 5/2009 | Wang et al. | |
| 2012/0135477 A1 | 5/2012 | Breuer et al. | |
| 2012/0237991 A1 | 9/2012 | Breuer et al. | |
| 2013/0273619 A1 | 10/2013 | Bonnekessel et al. | |
| 2016/0304911 A1 | 10/2016 | Sato et al. | |

FOREIGN PATENT DOCUMENTS

| | | |
|---|---|---|
| CN | 105 037 308 A | 11/2015 |
| EP | 2 438 182 A2 | 12/2010 |
| JP | 2009-060799 A | 3/2009 |
| JP | 2013-132226 A | 7/2013 |
| JP | 2017-074053 A | 4/2017 |
| WO | WO 2004/063699 A2 | 7/2004 |
| WO | WO 2010/139710 A1 | 12/2010 |
| WO | WO 2012/066059 A2 | 5/2012 |
| WO | WO 2015/033746 A1 | 3/2015 |
| WO | WO 2015/059290 A1 | 4/2015 |
| WO | WO 2015/059293 A1 | 4/2015 |
| WO | WO 2016/170106 A1 | 10/2016 |
| WO | WO 2018/157021 A1 | 8/2018 |

OTHER PUBLICATIONS

Broun et al., Catalytic plasticity of fatty acid modification enzymes underlying chemical diversity of plant lipids. Science, 1998, vol. 282: 1315-1317. (Year: 1998).*
Devos et al., Practical limits of function prediction. Proteins: Structure, Function, and Genetics. 2000, vol. 41: 98-107. (Year: 2000).*
Seffernick et al., Melamine deaminase and Atrazine chlorohydrolase: 98 percent identical but functionally different. J. Bacteriol., 2001, vol. 183 (8): 2405-2410. (Year: 2001).*
Seitz VM., Ph.D., Dissertation thesis, 2013, pp. 1-176. (Year: 2013).*
Siedenburg et al., Minireview: Squalene-Hopene cyclases, Appl. Environ. Micrbiol., 2011, vol. 77(12): 3905-3915. (Year: 2011).*
Whisstock et al., Prediction of protein function from protein sequence. Q. Rev. Biophysics., 2003, vol. 36 (3): 307-340. (Year: 2003).*
Witkowski et al., Conversion of b-ketoacyl synthase to a Malonyl Decarboxylase by replacement of the active cysteine with glutamine. Biochemistry, 1999, vol. 38: 11643-11650. (Year: 1999).*
Guo et al., Protein tolerance to random amino acid change. PNAS., 2004, vol. 101 (25): 9205-9210. (Year: 2004).*
PCT/EP2016/058987—International Search Report, dated Aug. 16, 2016.
PCT/EP2016/058987—International Written Opinion, dated Aug. 16, 2016.
Great Britain Search Report GB 1507207.7, dated Jan. 25, 2016.
Decorzant, et al., "A Short Synthesis of Ambrox® from Sclareol", Tetrahedron, Jan. 1, 1987, vol. 43, No. 8, pp. 1871-1879, Elsevier Science Publishers, Amsterdam, Netherlands.
Leffingwell, et al., "Biotechnology-Conquests and Challenges in Flavors and Fragrances", Leffingwell Reports, Mar. 1, 2015, vol. 7, No. 2, pp. 1-11.

(Continued)

*Primary Examiner* — Ganapathirama Raghu
(74) *Attorney, Agent, or Firm* — Curatolo Sidoti Co., LPA; Salvatore A. Sidoti; Floyd Trillis, III

(57) ABSTRACT

There is provided SHC/HAC derivatives, amino acid sequences comprising the SHC/HAC derivatives, nucleotide sequences encoding the SHC/HAC derivatives, vectors comprising nucleotide sequences encoding the SHC/HAC derivatives, recombinant host cells comprising nucleotide sequences encoding the SHC/HAC derivatives and applications of the recombinant host cells comprising either SHC/HAC derivatives or WT SHC/HAC enzymes in methods to prepare (−)-Ambrox and SHC/HAC enzymes in methods to prepare (−)-Ambrox.

25 Claims, 20 Drawing Sheets

Specification includes a Sequence Listing.

(56) References Cited

OTHER PUBLICATIONS

Seitz et al., "Substrate specificity of a novel squalene-hopene cyclase from Zymomonas mobilis", J. Molecular Catalysis B: Enzymatic, Dec. 2012, vol. 84, pp. 72-77. (Only Abstract provided).
Bernd Schaefer, "Irresistible Fragrance Note—Ambrox®", Chemie Unserer Zeit, vol. 45, pp. 374-388, 2011.
Neumann, et al., "Purification, Partial Characterization and Substrate Specificity of a Squalene Cyclase from *Bacillus acidocaldarius*", Biol. Chem. Hoppe-Seyler, vol. 367, pp. 723-729, Aug. 1986.
Seckler, et al., "Characterization and partial purification of squalene-hopene cyclase from *Bacillus acidocaldarius*", Biochem. Biophys. Act., vol. 881, Issue 3, pp. 356-363, May 1986.
Ochs, et al., "Cloning, Expression, and Sequencing of Squalene-Hopene Cyclase, A Key Enzyme in Triterpenoid Metabolism", Journal of Bacteriology, American Society for Microbiology, vol. 174, No. 1, pp. 298-302, Jan. 1, 1992.
Merkofer, et al., "Altered Product Pattern of a Squalene-Hopene Cyclase by Mutagenesis of Active Site Residues", Tetrahedron Letters, vol. 40, pp. 2121-2124, 1999.
Pale-Grosdemange, et al., "Production of Bicyclic and Tricyclic Triterpenes by Mutated Squalene-Hopene Cyclase", Tetrahedron Letters, vol. 40, pp. 6009-6012, 1999.
Hoshino, et al., "Enzymatic cyclization reactions of geraniol, farnesol and geranylgeraniol, and of those truncated squalene analogs having $C_{20}$ and $C_{25}$ by recombinant squalene cyclase", Org. Biomol. Chem., vol. 2, pp. 2650-2657, 2004.
Hoshino, et al., "Squalene-hopene cyclase: catalytic mechanism and substrate recognition", Chem. Commun. pp. 291-301, Jan. 17, 2002.
Reipen, et al., "*Zymomonas mobilis* squalene-hopene cyclase gene (shc): cloning, DNA sequence analysis, and expression in *Escherichia coli*", Microbiology, vol. 141, pp. 155-161, 1995.
Sato, et al., "Overexpression of Squalene-Hopene Cyclase by the pET vector in *Escherichia Coli* and First Identification of Tryptophan and Aspartic Acid Residues inside the QW Motif as Active Sites", Biosci. Biotechnol. Biochem., vol. 62, No. 2, pp. 407-411, 1998.
Robert Clarke, "The Origin of Ambergis", LAJAM, vol. 5, No. 1, pp. 7-21, Jun. 2006.
Panten, et al., "Recent Results in the Search for New Molecules with Ambergis Odor", Chemistry & Biodiversity, vol. 11, pp. 1639-1650, 2014.
Escher, et al., "Configuration-Odor Relationships in 5β-Ambrox", Helvetica Chimica Acta, vol. 73, pp. 1935-1947, 1990.
Perzl, et al., "Squalene-hopene cyclase from *Bradyrhizobium japonicum*: cloning, expression, sequence analysis and comparison to other triterpenoid cyclases", Microbiology, vol. 143, pp. 1235-1242, 1997.
Tippelt, et al., "Squalene-hopene cyclase *Methylococcus capsulatus* (Bath): a bacterium producing hopanoids and steroids", Biochimica et Biophysica Acta, vol. 1391, pp. 223-232, 1998.
Wendt, et al., "Structure and Function of a Squalene Cyclase", Science, vol. 277, pp. 1811-1815, Sep. 19, 1997.
Wendt, et al., "The Structure of the Membrane Protein Squalene-Hopene Cyclase at 2.0 Å Resolution", J. Mol. Biol., vol. 286, pp. 175-187, 1999.

\* cited by examiner

| | | |
|---|---|---|
| SHCwt | MAEQLVEAPAYARTLDRAVEYLLSCQKDEGYWWGPLLSNVTMEAEYVLLCHILDRVDRDRMEKIRRYLLHEQREDGTWALYPGGPP | 86 |
| SHC1 | MAEQLVEAPAYARTLDRAVEYLLSCQKDEGYWWGPLLSNVTMEAEYVLLCHILDRVDRDRMEKIRRYLLHEQREDGTWALYPGGPP | 86 |
| SHC2 | MAEQLVEAPAYARTLDRAVEYLLSCQKDEGYWWGPLLSNVTMEAEYVLLCHILDRVDRDRMEKIRRYLLHEQREDGTWALYPGGPP | 86 |
| SHC3 | MAEQLVEAPAYARTLDRAVEYLLSCQKDEGYWWGPLLSNVTMEAEYVLLCHILDRVDRDRMEKIRRYLLHEQREDGAWALYPGGPP | 86 |
| SHC4 | MAEQLVEAPAYARTLDRAVEYLLSCQKDEGYWWGPLLSNVTMEAEYVLLCHILDRVDRDRMEKIRRYLLHEQREDGTWALYPGGPP | 86 |
| SHC5 | MAEQLVEAPAYARTLDRAVEYLLSCQKDEGYWWGPLLSNVTMEAEYVLLCHILDRVDRDRMEKIRRYLLHEQREDGTWALYPGGPP | 86 |
| SHC6 | MAEQLVEAPAYARTLDRAVEYLLSCQKDEGYWWGPLLSNVTMEAEYVLLCHILDRVDRDRMEKIRRYLLHEQREDGTWALYPGGPP | 86 |
| SHC7 | MAEQLVEAPAYARTLDRAVEYLLSCQKDEGYWWGPLLSNVTMEAEYVLLCHILDRVDRDRMEKIRRYLLHEQREDGTWALYPGGPP | 86 |
| SHC8 | MAEQLVEAPAYARTLDRAVEYLLSCQKDEGYWWGPLLSNVTMEAEYVLLCHILDRVDRDRMEKIRRYLLHEQREDGTWALYPGGPP | 86 |
| SHC9 | MAEQLVEAPAYARTLDRAVEYLLSCQKDEGYWWGPLLSNVTMEAEYVLLCHILDRVDRDRMEKIRRYLLHEQREDGTWALYPGGPP | 86 |
| SHC10 | MAEQLVEAPAYARTLDRAVEYLLSCQKDEGYWWGPLLSNVTMEAEYVLLCHILDRVDRDRMEKIRRYLLHEQREDGTWALYPGGPP | 86 |
| SHCwt | DLDTTIEAYVALKYIGMSRDEEPMQKALRFIQSQGGIESSRVFTRMWLALVGEYPWEKVPMVPPEIMFLGKRMPLNIYEFGSWARA | 172 |
| SHC1 | DLDTTIEAYVALKYIGMSRDEEPMQKALRFIQSQGGIESSRVFTRMWLALVGEYPWEKVPMVPPEIMFLGKRMPLNIYEFGSWARA | 172 |
| SHC2 | DLDTTVEAYVALKYIGMSRDEEPMQKALRFIQSQGGIESSRVFTRMWLALVGEYPWEKVPMVPPEIMFLGKRMPLNIYEFGSWARA | 172 |
| SHC3 | DLDTTIEAYVALKYIGMSRDEEPMQKALRFIQSQGGIESSRVLTRMWLALVGEYPWEKVPMVPPEIMFLGKRMPLNIYEFGSWARA | 172 |
| SHC4 | DLDTTIEAYVALKYIGMSRDEEPMQKALRFIQSQGGIESSRVFTRWWLALVGEYPWEKVPMVPPEIMFLGKRMPLNIYEFGSWARA | 172 |
| SHC5 | DLDTTIEAYVALKYIGMSRDEEPMQKALRFIQSQGGIESSRVLTRWWLALVGEYPWEKVPMVPPEIMFLGKRMPLNIYEFGSWARA | 172 |
| SHC6 | DLDTTIEAYVALKYIGMSRDEEPMQKALRFIQSQGGIESSRVFTRWWLALVGEYPWEKVPMVPPEIMFLGKRMPLNIYEFGSWARA | 172 |
| SHC7 | DLDTTIEAYVALKYIGMSRDEEPMQKALRFIQSQGGIESSRVFTRMWLALVGEYPWEKVPMVPPEIMFLGKRMPLNIYEFGSWARA | 172 |
| SHC8 | DLDTTIEAYVALKYIGMSRDEEPMQKALRFIQSQGGIESSRVLTRWWLALVGEYPWEKVPMVPPEIMFLGKRMPLNIYEFGSWARA | 172 |
| SHC9 | DLDTTIEAYVALKYIGMSRDEEPMQKALRFIQSQGGIESSRVFTRMWLALVGEYPWEKVPMVPPEIMFLGKRMPLNIYEFGSWARA | 172 |
| SHC10 | DLDTTIEAYVALKYIGMSRDEEPMQKALRFIQSQGGIESSRVLTRWWLALVGEYPWEKVPMVPPEIMFLGKRMPLNIYEFGSWARA | 172 |

FIG. 1

| | | |
|---|---|---|
| SHCwt  | TVVALSIVMSRQPVFPLPERARVPELYETDVPPRRGAKGGGWIFDALDRALHGYQKLSVHPFRRAAEIRALDWLLERQAGDGSW | 258 |
| SHC1   | TVVALSIVMSRQPVFPLPERARVPELYETDVPPRRGAKGGGWIFDALDRALHGYQKLSVHPFRRAAEIRALDWLLERQAGDGSW | 258 |
| SHC2   | TVVALSIVMSRQPVFPLPERARVPELYETDVPPRRGAKGGGWIFDALDRALHGYQKLSVHPFRRAAEIRALDWLLERQAGDGSW | 258 |
| SHC3   | TVVALSIVMSRQPVFPLPERARVPELYETDVPPRRGAKGGGWIFDALDRALHGYQKLSVHPFRRAAEIRALDWLLERQAGDGSW | 258 |
| SHC4   | TVVALSIVMSRQPVFPLPERARVPELYETDVPPRRGAKGGGWIFDALDRMHGYQKLSVHPFRRAAEIRALDWLLERQAGDGSW | 258 |
| SHC5   | TVVALSIVMSRQPVFPLPERARVPELYETDVPPRRGAKGGGWIFDALDRALHGYQKLSVHPFRRAAEIRALDWLLERQAGDGSW | 258 |
| SHC6   | TVVALSIVMSRQPVFPLPERARVPELYETDVPPRRGAKGGGWIFDALDRALHGYQKLSVHPFRRAAEIRALDWLLERQAGDGSW | 258 |
| SHC7   | TVVALSIVMSRQPVFPLPERARVPELYETDVPPRRGAKGGGWIFDALDRALHGYQKLSVHPFRRAAEIRALDWLLERQAGDGSW | 258 |
| SHC8   | TVVALSIVMSRQPVFPLPERARVPELYETDVPPRRGAKGGGWIFDALDRALHGYQKLSVHPFRRAAEIRALDWLLERQAGDGSW | 258 |
| SHC9   | TVVALSIVMSRQPVFPLPERARVPELYETDVPPRRGAKGGGWIFDALDRALHGYQKLSVHPFRRAAEIRALDWLLERQAGDGSW | 258 |
| SHC10  | TVVALSIVMSRQPVFPLPERARVPELYETDVPPRRGAKGGGWIFDALDRALHGYQKLSVHPFRRAAEIRALDWLLERQAGDGSW | 258 |
| SHCwt  | GGIQPPWFYALIALKILDMTQHPAFIKGWEGLELYGVELDYGGWMFQASISPVWDTGLAVLALRAAGLPADHDRLVKAGEWLLDRQ | 344 |
| SHC1   | GGIQPPWFYALIALKILDMTQHPAFIKGWEGLELYGVELDYGGWMFQASISPVWDTGLAVLALRAAGLPADHDRLVKAGEWLLDRQ | 344 |
| SHC2   | GGIQPPWFYALIALKILDMTQHPAFIKGWEGLELYGVELDYGGWMFQASISPVWDTGLAVLALRAAGLPADHDRLVKAGEWLLDRQ | 344 |
| SHC3   | GGIQPPWFYALIALKILDMTQHPAFIKGWEGLELYGVELDYGGWMFQASISPVWDTGLAVLALRAAGLPADHDRLVKAGEWLLDRQ | 344 |
| SHC4   | GGIQPPWFYALIALKILDMTQHPAFIKGWEGLELYGVELDYGGWMFQASISPVWDTGLAVLALRAAGLPADHDRLVKAGEWLLDRQ | 344 |
| SHC5   | GGIQPPWFYALIALKILDMTQHPAFIKGWEGLELYGVELDYGGWMFQASISPVWDTGLAVLALRAAGLPADHDRLVKAGEWLLDRQ | 344 |
| SHC6   | GGIQPPWFYALIALKILDMTQHPAFIKGWEGLELYGVELDYGGWMFQASISPVWDTGLAVLALRAAGLPADHDRLVKAGEWLLDRQ | 344 |
| SHC7   | GGIQPPWFYALIALKILDMTQHPAFIKGWEGLELYGVELDYGGWMFQASISPVWDTGLAVLALRAAGLPADHDRLVKAGEWLLDRQ | 344 |
| SHC8   | GGIQPPWFYALIALKILDMTQHPAFIKGWEGLELYGVELDYGGWMFQASISPVWDTGLAVLALRAAGLPADHDRLVKAGEWLLDRQ | 344 |
| SHC9   | GGIQPPWFYALIALKILDMTQHPAFIKGWEGLELYGVELDYGGWMFQASISPVWDTGLAVLALRAAGLPADHDRLVKAGEWLLDRQ | 344 |
| SHC10  | GGIQPPWFYALIALKILDMTQHPAFIKGWEGLELYGVELDYGGWMFQASISPVWDTGLAVLALRAAGLPADHDRLVKAGEWLLDRQ | 344 |

FIG. 2

```
SHCwt    ITVPGDWAVKRPNLKPGGFAFQFDNVYYPDVDDTAVVWALNTLRLPDERRRDAMTKGFRWIVGMQSSNGGWGAYDVDNTSDLPN  430
SHC1     ITVPGDWAVKRPNLKPGGFAFQFDNVYYPDVDDTAVVWALNTLRLPDERRRDAMTKGFRWIVGMQSSNGGWGAYDVDNTSDLPN  430
SHC2     ITVPGDWAVKRPNLKPGGFAFQFDNVYYPDVDDTAVVWALNTLRLPDERRRDAMTKGFRWIVGMQSSNGGWGAYDVDNTSDLPN  430
SHC3     ITVPGDWAVKRPNLKPGGFAFQFDNVYYPDVDDTAVVWALNTLRLPDERRRDAMTKGFRWIVGMQSSNGGWGAYDVDNTSDLPN  430
SHC4     ITVPGDWAVKRPNLKPGGFAFQFDNVYYPDVDDTAVVWALNTLRLPDERRRDAMTKGFRWIVGMQSSNGGWGAYDVDNTSDLPN  430
SHC5     ITVPGDWAVKRPNLKPGGFAFQFDNVYYPDVDDTAVVWALNTLRLPDERRRDAMTKGFRWIVGMQSSNGGWGAYDVDNTSDLPN  430
SHC6     ITVPGDWAVKRPNLKPGGFAFQFDNVYYPDVDDTAVVWALNTLRLPDERRRDAMTKGFRWIVGMQSSNGGWGAYDVDNTSDLPN  430
SHC7     ITVPGDWAVKRPNLKPGGFAFQFDNVYYPDVDDTAVVWALNTLRLPDERRRDAMTKGFRWIVGMQSSNGGWGAYDVDNTSDLPN  430
SHC8     ITVPGDWAVKRPNLKPGGFAFQFDNVYYPDVDDTAVVVWALNTLRLPDERRRDAMTKGFRWIVGMQSSNGGWGAYDVDNTSDLPN  430
SHC9     ITVPGDWAVKRPNLKPGGFAFQFDNVYYPDVDDTAVVWALNTLRLPDERRRDAMTKGFRWIVGMQSSNGGWGAYDVDNTSDLPN  430
SHC10    ITVPGDWAVKRPNLKPGGFAFQFDNVYYPDVDDTAVVWALNTLRLPDERRRDAMTKGFRWIVGMQSSNGGWGAYDVDNTSDLPN  430

SHCwt    HIPFCDFGEVTDPPSEDVTAHVLECFGSFGYDDAWKVIRRAVEYLKREQKPDGSWFGRWGVNYLYGTGAVVSALKAVGIDTREPYI  516
SHC1     HIPFCDFGEVTDPPSEDVTAHVLECFGSFGYDDAWKVIRRAVEYLKREQKPDGSWFGRWGVNYLYGTGAVVSALKAVGIDTREPYI  516
SHC2     HIPFCDFGEVTDPPSEDVTAHVLECFGSFGYDDAWKVIRRAVEYLKREQKPDGSWFGRWGVNYLYGTGAVVSALKAVGIDTREPYI  516
SHC3     HTPFCDFGEVTDPPSEDVTAHVLECFGSFGYDDAWKVIRRAVEYLKREQKPDGSWFGRWGVNYLYGTGAVVSALKAVGIDTREPYI  516
SHC4     HIPFCDFGEVTDPPSEDVTAHVLECFGSFGYDDAWKVIRRAVEYLKREQKPDGSWFGRWGVNYLYGTGAVVSALKAVGIDTREPYI  516
SHC5     HIPFCDFGEVTDPPSEDVTAHVLECFGSFGYDDAWKVIRRAVEYLKREQKPDGSWFGRWGVNYLYGTGAVVSALKAVGIDTREPYI  516
SHC6     HTPFCDFGEVTDPPSEDVTAHVLECFGSFGYDDAWKVIRRAVEYLKREQKPDGSWFGRWGVNYLYGTGAVVSALKAVGIDTREPYI  516
SHC7     HIPFCDFGEVTDPPSEDVTAHVLECFGSFGYDDAWKVIRRAVEYLKREQKPDGSWFGRWGVNYLYGTGAVVSALKAVGIDTREPYI  516
SHC8     HTPFCDFGEVTDPPSEDVTAHVLECFGSFGYDDAWKVIRRAVEYLKREQKPDGSWFGRWGVNYLYGTGAVVSALKAVGIDTREPYI  516
SHC9     HIPFCDFGEVTDPPSEDVTAHVLECFGSFGYDDAWKVIRRAVEYLKREQKPDGSWFGRWGVNYLYGTGAVVSALKAVGIDTREPYI  516
SHC10    HIPFCDFGEVTDPPSEDVTAHVLECFGSFGYDDAWKVIRRAVEYLKREQKPDGSWFGRWGVNYLYGTGAVVSALKAVGIDTREPYI  516
```

FIG. 3

```
SHCwt   QKALDWVEQHQNPDGGWGEDCRSYEDPAYAGKGASTPSQTAWALMALIAGGRAESEAARRGVQYLVETQRPDGGWDEPYYTGTGFP  602
SHC1    QKALDWVEQHQNPDGGWGEDCRSYEDPAYAGKGASTPSQTAWALMALIAGGRAESEAARRGVQYLVETQRPDGGWDEPYYTGTGYP  602
SHC2    QKALDWVEQHQNPDGGWGEDCRSYEDPAYAGKGASTPSQTAWALMALIAGGRAESEAARRGVQYLVETQRPDGGWDEPYYTGTGFP  602
SHC3    QKALDWVEQHQNPDGGWGEDCRSYEDPAYAGKGASTPSQTAWALMALIAGGRAESEAARRGVQYLVETQRPDGGWDEPYYTGTGFP  602
SHC4    QKALDWVEQHQNPDGGWGEDCRSYEDPAYAGKGASTPSQTAWALMALIAGGRAESEAARRGVQYLVETQRPDGGWDEPYYTGTGYP  602
SHC5    QKALDWVEQHQNPDGGWGEDCRSYEDPAYAGKGASTPSQTAWALMALIAGGRAESEAARRGVHYLVETQRPDGGWDEPYYTGTGFP  602
SHC6    QKALDWVEQHQNPDGGWGEDCRSYEDPAYAGKGASTPSQTAWALMALIAGGRAESEAARRGVQYLVETQRPDGGWDEPYYTGTGFP  602
SHC7    QKALDWVEQHQNPDGGWGEDCRSYEDPAYAGKGASTPSQTAWALMALIAGGRAESEAARRGVQYLVETQRPDGGWDEPYYTGTGYP  602
SHC8    QKALDWVEQHQNPDGGWGEDCRSYEDPAYAGKGASTPSQTAWALMALIAGGRAESEAARRGVQYLVETQRPDGGWDEPYYTGTGFP  602
SHC9    QKALDWVEQHQNPDGGWGEDCRSYEDPAYAGKGASTPSQTAWALMALIAGGRAESEAARRGVQYLVETQRPDGGWDEPYYTGTGYP  602
SHC10   QKALDWVEQHQNPDGGWGEDCRSYEDPAYAGKGASTPSQTAWALMALIAGGRAESEAARRGVQYLVETQRPDGGWDEPYYTGTGYP  602

SHCwt   GDFYLGYTMYRHVFPTLALGRYKQAIERR  631
SHC1    GDFYLGYTMYRHVFPTLALGRYKQAIERR  631
SHC2    GDFYLGYTMYRHVFPTLALGRYKQAIERR  631
SHC3    GDFYLGYTMYRHVFPTLALGRYKQAIERR  631
SHC4    GDFYLGYTMYRHVFPTLALGRYKQAIERR  631
SHC5    GDFYLGYTMYRHVFPTLALGRYKQAIERR  631
SHC6    GDFYLGYTMYRHVFPTLALGRYKQAIERR  631
SHC7    GDFYLGYTMYRHVFPTLALGRYKQAIERR  631
SHC8    GDFYLGYTMYRHVFPTLALGRYKQAIERR  631
SHC9    GDFYLGYTMYRHVFPTLALGRYKQAIERR  631
```

FIG. 4

ENZYMES AND APPLICATIONS THEREOF

CROSS REFERENCE TO RELATED APPLICATIONS

This application is a national stage application of International Application No. PCT/EP2016/058987 filed 22 Apr. 2016, which claims priority from Great Britain Patent Application No. 1507207.7, filed 24 Apr. 2015, which application are incorporated herein by reference.

SEQUENCE LISTING

Attach to this Amendment is a Sequence Listing as filed in the International application. The Sequence Listing includes sequence for SEQ ID NOS: 1-188. Please add the Sequence Listing to the present application.

FIELD OF THE INVENTION

The present invention relates to Squalene Hopene Cyclase/Homofarnesol Ambrox Cyclase (SHC/HAC) derivative enzymes which have been modified with respect to a reference SHC/HAC protein, amino acid sequences comprising the SHC/HAC derivative enzymes, nucleotide sequences encoding the SHC/HAC derivatives, vectors comprising nucleotide sequences encoding the SHC/HAC derivatives and recombinant host cells comprising nucleotide sequences encoding the SHC/HAC derivatives. The present invention also relates to means for functionally expressing nucleotide sequences encoding SHC/HAC derivatives and methods of using recombinant microorganisms comprising nucleotide sequences encoding SHC/HAC derivatives and WT SHC/HAC to make Ambrox, preferably (−)-Ambrox.

BACKGROUND OF THE INVENTION

Squalene Hopene Cyclases (SHC, EC 5.4.99.17) are membrane-bound prokaryotic enzymes which act as biocatalysts for the cyclisation of the linear triterpenoid squalene to hopene and hopanol. Earlier SHC work focused on the characterisation of the SHC of the thermophilic and acidophilic bacterium *Alicyclobacillus acidocaldarius* (formerly *Bacillus acidocaldarius*) (see Neumann & Simon 1986, Biol Chem Hoppe-Seyler 367, 723-729; Seckler & Poralla 1986, Biochem Biophys Act 356-363 and Ochs et al 1990, J Bacteriol 174, 298-302). However, more recently, other SHCs from *Zymomonas mobilis* and *Bradyrhizobium japonicum* have been purified and characterized in terms of their natural (eg. squalene) and non-natural substrates (eg. homofarnesol and citral) (see for example, WO 2010/139710, WO 2012/066059 and Seitz et al 2012, J. Molecular Catalysis B: Enzymatic 84, 72-77).

Earlier work by Neumann and Simon (1986—as cited above) disclosed that homofarnesol is an additional substrate for *Alicyclobacillus acidocaldarius* SHC (AacSHC). However, the cyclisation rate of the non-natural homofarnesol by the purified AacSHC taught by Neumann and Simon (1986) was reported at only 3% of the cyclisation rate for the natural substrate squalene. The rate of formation of Ambrox (product 2b) increased with the concentration of homofarnesol (product 1b) from 0.25 mM to 2.0 mM and declined slightly in the presence of 4 mM of product 1b. The difference in cyclisation rates may be attributed in part to the fact that the natural SHC substrate squalene is twice the size (a C30 carbon compound) of the non-natural homofarnesol which is a C16 carbon compound.

(JP2009060799—Kao) also discloses a method for producing Ambrox from homofarnesol using an SHC from *A. acidocadarius*. Whilst JP2009060799 teaches the possibility of using microorganisms comprising SHC for the synthesis of Ambrox, JP2009060799 only discloses the production of Ambrox from homofarnesol using an SHC liquid extract prepared from a recombinant microorganism expressing the SHC gene and not by means of whole recombinant microbial cells expressing the SHC gene. The percent conversion of homofarnesol to Ambrox using an SHC liquid extract was reported as 17.5% when carried out at a temperature of 60° C. for 14 hour at pH 5.2-6.0 but only as 6.8% when carried out at a pH of 6.6. The percent conversion of 3E, 7E-homofarnesol to Ambrox using an SHC liquid extract at 60° C. at pH 5.6 for 64 hours was reported as 63% when a 0.2% homofarnesol (2 g/l) substrate concentration is used.

WO 2010/139719A2 and its US equivalent (US2012/0135477A1) describe at least three SHC enzyme extracts with homofarnesol to Ambrox cyclase activity. The *Zymomonas mobilis* (Zmo) SHC and the *Bradyrhizobium japonicum* (Bjp) SHC enzymes are reported to show homofarnesol conversion rates of 41% at 16 h of reaction and 22% respectively when a 10 mM (2.36 g/l) homofarnesol concentration was used while the conversion rate for AacSHC was reported to be only 1.2% (presumably at the same homofarnesol concentration) but no experimental details are provided. The ZmoSHC and BjpSHC enzyme extracts were prepared from a recombinant microorganism expressing the SHC gene by disrupting the *E. coli* host cells producing the SHC enzymes and separating the soluble SHC fractions.

Seitz et al (2012—as cited above) reports on the functional expression and biochemical characterisation of three SHC enzymes, two from *Z. mobilis* (ZmoSHC1 and ZmoSHC2) and one from *A. acidocaldarius*. It is reported that an "efficient" conversion (22.95%) of homofarnesol to Ambrox was observed using the wild-type ZmoSHC1 with no conversion of homofarnesol to Ambrox using WT ZmoSHC2 and a relatively low conversion (3.4%) of homofarnesol to Ambrox for AacSHC was found when a 10 mM (2.36 g/l) homofarnesol concentration was used. The trend observed for the relatively low conversion of homofarnesol to Ambrox for AacSHC which was in accord with the results of Neumann and Simon (1986—as cited above) and as disclosed in WO 2010/139719A2 as also discussed above. The three SHC enzymes were used in a cell suspension format (through partial disruption of host *E. coli* cells using freeze-thaw cycles) and as partially purified membrane-bound fractions.

WO2012/066059 discloses mutants with cyclase-activity and the use thereof in a method for the biocatalytic cyclisation of terpenes, such as, in particular, for producing isopulegol by the cyclisation of citronellal; to a method for producing menthol and methods for the biocatalytic conversion of other compounds with terpene type structural motifs. Sequence alignment of various SHCs identified phenylalanine-486 (F486) as a strongly conserved amino acid residue and a series of substitution variants were generated in the *Zymomonas mobilis* SHC enzyme. Some of these substitutions led to the loss of activity, while others resulted in the formation of novel terpenoid product (isopulegols) from terpene substrates such as citronellal.

A report in a PhD thesis by Seitz in 2012 entitled "Characterization of the Substrate Specificity of Squalene-Hopence Cyclases (SHCs)" indicates that an F486Y mutation in ZmoSHC1 provided a diminished rate for homofarnesol biotransformation of about 1.5 fold from 34.8% (WT ZmoSHC1) to 23.9% (mutant ZmoSHC1F486Y). When the mutation equivalent (Y420C) in AacSHC was tested, it was presumed that the enzymatic activity towards the larger substrates would decrease and the activity towards smaller substrates would rise. When the mutant was tested under the same conditions as the wild-type and the enzymatic activities were compared, it was observed that the mutant did not show any conversion of the homofarnesol substrate at all. Therefore it was concluded that Y420 amino acid residue was crucial for the activity of AacSHC for all substrates. Other SHC site directed mutagenesis studies in the art (eg. Hoshino and Sato 2002, Chem Commun 291-301) were focused on the effect of mutations in highly conserved regions (eg. F601) and their effect on natural substrates (i.e. squalene or squalene analogues) rather than on non-natural substrates such as homofarnesol.

In summary, the limited disclosures in the art relating to bioconversion processes for the successful conversion of homofarnesol to Ambrox only relate to relatively low concentrations/volumes of homofarnesol substrate (in the concentration range of from 0.25 mM to 2 mM to 10 mM or around 0.06 g/l to 2.36 g/l) using a wild-type SHC polypeptide with the activity of a homofarnesol-Ambrox cyclase (HAC). The SHC enzymes with HAC activity were either: (i) liquid extracts which were prepared either by disrupting the E. coli host cells comprising the SHC enzymes and separating the insoluble and soluble SHC liquid fractions; (ii) partially purified membrane fractions; or (iii) recombinant whole cells expressing the WT SHC gene and producing the SHC enzyme for use in reactions for bioconverting homofarnesol to Ambrox using solubilizing agents including either: (i) Triton X-100 in the reaction mixture (see Neumann and Simon 1986 as cited above, Seitz et al 2012 as cited above, JP2009060799); or (ii) taurodeoxycholate (as disclosed in US2012/0135477A).

Using these WT SHC extracts and/or whole recombinant microbial cells expressing the SHC gene, the homofarnesol to Ambrox conversion rates obtained were found to vary depending on the source of the SHC enzyme, the amount of the homofarnesol starting material and the reaction conditions used. So far, a 100% percent conversion of homofarnesol to Ambrox using a wild-type SHC enzyme has not been achieved at the reported involved concentrations (0.06-2.36 g/l). In addition, preliminary investigations using SHC derivatives prepared using site directed mutagenesis studies have only provided negative (i.e. reduced homofarnesol conversion rates) rather than positive (i.e. improved conversion rates) results. In addition, only purified SHC enzyme extracts or SHC membrane bound fractions have been used in the published studies or whole recombinant microbial cells expressing a WT SHC gene under specific reaction conditions which use solubilizing agents such as Triton X-100 or taurodeoxycholate. There is no demonstration that a recombinant microorganism comprising either a WT or mutant SHC might provide a more efficient and cost effective bioconversion of homofarnesol to Ambrox using optimized reaction conditions. Accordingly, it is desired to improve the cited known processes for preparing Ambrox from homofarnesol by at least improving reaction velocity, specificity, yield, productivity and reducing costs (by, for example, simplifying the process using either recombinant whole microbial cells or by using a "one pot" process combining both biocatalyst production and bioconversion steps).

SUMMARY OF THE INVENTION

The present invention in various aspects provides SHC/HAC derivatives, amino acid sequences comprising the SHC/HAC derivative enzymes, nucleotide sequences encoding the SHC/HAC derivative enzymes, vectors comprising nucleotide sequences encoding the SHC/HAC derivative enzymes, recombinant host cells comprising vectors with nucleotide sequences encoding the SHC/HAC derivative enzymes and applications of the recombinant host cells comprising either SHC/HAC derivative enzymes or WT SHC/HAC enzymes when used under specific reaction conditions in methods to prepare Ambrox materials comprising the Ambrox isomer designated (−)-Ambrox and Ambrox like molecules (as by products). Unlike the disclosures in the art relating to AacSHC, the Applicant has demonstrated for the first time that a whole recombinant microorganism expressing a SHC derivative gene can be used to bioconvert homofarnesol to Ambrox. In addition, a whole recombinant microorganism expressing a WT SHC gene and/or producing SHC enzymes can be used to bioconvert homofarnesol to Ambrox under specific reaction conditions not disclosed in the art.

It has also been surprisingly found that introducing up to five amino acid alterations into the amino acid sequence of the WT SHC/HAC reference sequence as disclosed herein leads to SHC/HAC derivative enzymes with significantly improved homofarnesol to Ambrox conversion rates as compared with the unmodified SHC reference enzymes as disclosed herein. These novel SHC/HAC derivative enzymes are useful alone and in combination for the production of Ambrox materials, in particular (−)-Ambrox from homofarnesol substrates.

An additional surprising finding is that apart from one mutant (F601Y), the SHC derivative enzymes as disclosed herein typically comprise non-conservative substitutions at amino acid residue positions in the non-conserved part of the reference SHC polypeptide sequence. This is an unexpected finding as changes in the conserved region of an enzyme are more likely to disrupt the function of an enzyme (at least in relation to its natural substrate) than changes in a non-conserved region of a protein.

A further surprising finding is that the characterised SHC derivative enzymes of the present disclosure perform optimally (on a non-natural substrate such as homofarnesol) at about 35° C. rather than about 60° C. which is the usual reaction temperature for thermophilic microorganisms such as AacSHC. The application of the SHC deriva-tives of the present disclosure in methods for preparing Ambrox from homofarnesol at lower reaction temperatures has significant cost advantages for the Ambrox production cycle at an industrial scale.

Another advantage of the present invention is that the SHC derivative enzymes of the present disclosure catalyse an efficient bioconversion process which when optimized with relatively high (eg. about 50 fold) homofarnesol substrate concentration compared to previously described concentrations in the prior art (eg. EEH at 125 g/l) can lead to 100% conversion of the homofarnesol substrate while the reference WT SHC protein only converts about 10% of the same substrate even at a high concentration of enzyme/cells. The disclosures in the cited prior art all relate to the use of purified membrane extracts comprising SHC or purified SHC extracts (prepared from micro-organisms expressing SHC genes) or the use of recombinant microorganism expressing a WT SHC gene under specific bioconversion reaction conditions (eg. using specific solubilizing agents).

Even then, a 100% homofarnesol conversion at much lower EEH concentration is not reported. Also a "one pot" reaction where in a first step the recombinant cells grow and produce the SHC enzyme and subsequently convert EEH to (−)-Ambrox in the same vessel has not been reported. A further advantage of the present invention is that the recombinant host cells producing the SHC derivative enzymes show high initial reaction rates which allow the production of a high quantity of product within a relatively short period of time while using only relatively low amounts of biocatalyst. In short, the selection and efficient expression and application of recombinant microorganisms comprising either WT SHC/HAC or specific SHC/HAC derivative enzymes under specific bioconversion reaction conditions leads to a more efficient bioconversion process. The end product ((−)-Ambrox) can be separated and easily purified. Unlike the cited art, the SHC/HAC derivative enzymes are not used as a pure enzyme but are used in a whole cell context (as the biocatalyst) which is a more cost effective and a more user and environmentally friendly approach as no additional enzyme purification and isolation steps are required.

In summary, the present disclosure provides a bioconversion/biotransformaton method for making Ambrox in a recombinant microbial strain of which is: (i) economically attractive, (ii) environmentally friendly and (iii) leads to the selective production of (−)-Ambrox as a predominant compound which under selective crystallization conditions is effectively separated from other by-products which do not contribute to the olfactive quality of the end product.

DETAILED DESCRIPTION OF THE INVENTION

As used herein, the term "SHC" means a Squalene Hopene Cyclase enzyme from any of the sources listed in Tables 10-12. In preferred embodiments, the term SHC includes the *Zymomonas mobilis* SHC enzymes and the *Alicyclobacillus acidocaldarius* SHC enzymes as disclosed in BASF WO 2010/139719, US2012/01345477A1, Seitz et al (2012 as cited above) and Seitz (2012 PhD thesis as cited above). For ease of reference, the designation "AacSHC" is used for *Alicyclobacillus acidocaldarius* SHC and the designation "ZmoSHC" is used for *Zymomonas mobilis* SHC and the designation "BjpSHC" is used for *Bradyrhizobium japonicum* SHC. The percent sequence identity for these sequences relating to WT AacSHC and each other (which can vary depending on the algorithm used) is set out in Tables 18 and 19.

An alignment of WT SHC sequences prepared by Hoshino and Sato (2002 as cited above) indicates that multiple motifs were detected in all four sequences and consists of the core sequence Gln-X—X—X-Gly-X-Trp which is found six times in the SHC sequences of both *Z. mobilis* and *A. acidocaldarius* (See FIG. 3 of Reipen et al 1995, Microbiology 141, 155-161). Hoshino and Sato (2002 as cited above) report that aromatic amino acids are unusually abundant in SHCs and that two characteristic motifs were noted in the SHCs: one is a QW motif represented by specific amino acid motifs [(K/R)(G/A)X2-3(F/Y/W)(L/IV)3X3QX2-5GXW] and the alternative is a DXDDTA motif. Wendt et al (1997, Science 277, 1811-1815 and 1999, J Mol Biol 286, 175-187) reported on the X-ray structure analysis of *A. acidocaldarius* SHC. The DXDDTA motif appears to correlate with the SHC active site. Exemplary sequence alignments from the prior art are showing the recurring multiple motifs as provided in FIG. 2 (from Hoshino and Sato (2002 as cited above)) and FIG. 3 (from Seitz PhD thesis (2012)) herein.

The reference (or wild-type) AacSHC protein as used herein refers to the AacSHC protein as disclosed in SEQ ID No. 1. The reference AacSHC enzyme of the present disclosure has the activity of a homofarnesol Ambrox cyclase (HAC) useful in the production of Ambrox derivatives through a biocatalytic reaction of SHC with a homofarnesol substrate. The main reaction of the reference AacSHC is the cyclisation of a linear or a non-linear substrate such as homofarnesol to produce Ambrox.

Ambrox

As used herein, the term "Ambrox" includes (−)-Ambrox of formula (I) as well as (−)-Ambrox in stereoisomerically pure form or in a mixture with at least one or more of the following molecules of formula (II), (IV) and/or (III).

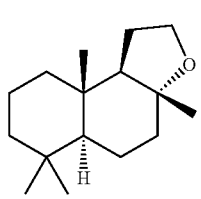

(I)

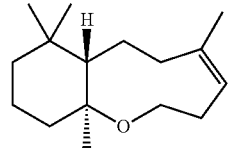

(II)

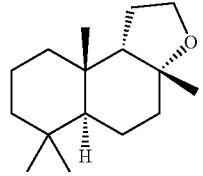

(III)

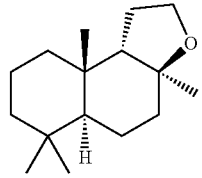

(IV)

(−)-Ambrox (−)-Ambrox is known commercially as Ambrox (Firmenich), Ambroxan (Henkel) Ambrofix (Givaudan), Amberlyn (Quest), Cetalox Laevo (Firmenich), Ambermor (Aromor) and/or Norambrenolide Ether (Pacific).

(−)-Ambrox is an industrially important aroma compound and has been used in the Fragrance industry for a long time. The special desirable sensory benefits from (−)-Ambrox come from the (−) stereoisomer rather than the (+) one. The odour of the (−) stereoisomer is described as musk-like, woody, warm or ambery whereas the (+)-Ambrox enantiomer has a relatively weak odour note. The odour and odour thresholds for Ambrox like products are also different. While various (−)-Ambrox enriched materials are available commercially, it is desirable to produce highly enriched (−)-Ambrox materials, ideally pure (−)-Ambrox.

Production of (−)-Ambrox (−)-Ambrox can be produced from sclareolide according to the production process as described below. Sclareol is a product extracted from the natural plant clary sage. However, because a natural starting material is used in this process, there are potential problems in that it involves a multistage reaction, its operation is circuitous, the quantity and stability of supply of starting material may not always be satisfactory, and the reaction may not be environmentally friendly because an oxidizing agent such as chromic acid or a permanganate is used in the step of (+)-sclareol oxidative degradation.

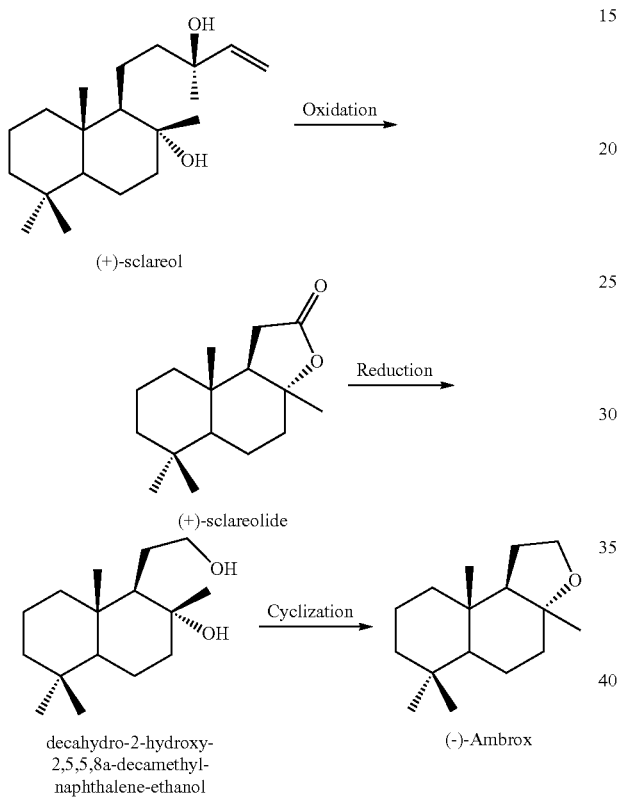

(+)-sclareol (+)-sclareolide decahydro-2-hydroxy-
2,5,5,8a-decamethyl-
naphthalene-ethanol (−)-Ambrox (−)-Ambrox is also synthesized from homofarnesol using different routes. By way of example, homofarnesol can be obtained by brominating, cyanating, and hydrolysing nerolidol to give homofarnesylic acid, followed by reduction. Alternatively, homofarnesol may be obtained from farnesol, farnesylchloride, beta-farnesene or other substrates. Beta-farnesene can be converted directly to E,E-homofarnesol (EEH) or indirectly to EEH via E,E-homofarnesate which is then converted to EEH. An overview on the production of (−)-Ambrox from different substrates can be found in US2012/0135477A1, WO 2010/139719, US2013.0273619A1, WO 2013/156398A1 and the Seitz PhD thesis (2012 as cited above) and Schaefer 2011 (Chemie Unserer Zeit 45, 374-388).

Whilst homofarnesol may present as a mixture of four isomers, the (3Z,7Z), (3E,7Z), (3Z,7E) and (3E,7E) isomers, it seems from the literature that (−)-Ambrox is only obtained from (3E,7E) homofarnesol (see Neumann and Simon (1986) as cited above). As used herein, a reference to (3E,7E) homofarnesol is a reference to E,E-homofarnesol which is also designated as EEH.

US2012/0135477A1 reports on the cnversion of (3Z,7E) to (−)-Ambrox using ZmoSHC (SEQ ID No. 2) (see Examples 2-4) but according to the disclosure in Schaefer (2011) (as cited above), (7E, 3Z) is only converted to 9b-epi-Ambrox (i.e. compound III) as outlined above and not to (−)-Ambrox. As used herein, a reference to (3Z,7E) homofarnesol is a reference to E,Z-homofarnesol which is also designated as EZH.

In some embodiments, preferably the homofarnesol starting material comprises a mixture of (3E,7E) and (3Z,7E), termed herein an EE:EZ stereoisomeric mixture (particularly with reference to the Examples and Table 20.

An EE:EZ stereoisomeric mixture of homofarnesol has the CAS number of 35826-67-6.

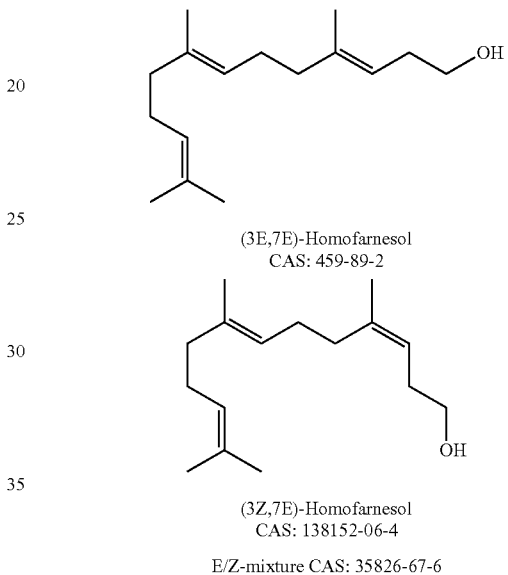

(3E,7E)-Homofarnesol
CAS: 459-89-2

(3Z,7E)-Homofarnesol
CAS: 138152-06-4

E/Z-mixture CAS: 35826-67-6

As the Examples demonstrate (eg. see Examples 5, 7, 9, 10, 11, 18, 19 and 20), in certain embodiment, the homofarnesol feedstock/starting material is a mixture of isomers.

Accordingly, in some embodiments, the homofarnesol starting material may also comprise a mixture of the four isomers EE:EZ:ZZ:ZE which corresponds with (3E,7E) and (3Z,7E), (3Z,7Z and 3E,7Z).

In some embodiments, preferably the homofarnesol starting material is selected from one of more of the following groups: [(3Z,7Z), (3E,7Z), (3Z,7E) and (3E,7E)], [(3Z,7E) and (3E,7E)], [(3Z,7E), (3E,7Z)] and/or [(3E,7E) and (3E,7Z)].

Preferably the homofarnesol starting material is selected from one or more of the following groups: [(3E,7E), (3Z,7E)] and/or [(3Z,7E), (3E,7E) and (3E,7Z)].

Accordingly, in certain embodiments, the ratio of EEH:EZH is about 100:00; 99:01; 98:02; 97:03; 96:04; 95:05; 94:06; 93:07; 92:08; 91:09; 90:10; 89:11; 88:12; 87:13; 86:14; 85:15; 84:16; 83:17; 82:18; 81:19; 80:20; 79:21; 78:22; 77:23; 76:24; 75:25; 74:26; 73:27; 72:28; 71:29; 70:30; 69:31; 68:32; 67:33; 66:34; 65:35; 64:36; 63:37; 62:38; 61:39; 60:40; 59:41; 58:42; 57:43; 56:44; 55:45; 54:46; 53:47; 52:48; 51:49; or about 50:50.

In some embodiments preferably the homofarnesol starting material comprises >90% E,E-homofarnesol (EEH).

In other embodiments, the homofarnesol starting material comprises an EE:EZ weight ratio of 86:14.

In certain embodiments, the homofarnesol starting material comprises an EE:EZ weight weight ratio of 80:20.

In certain embodiments, the homofarnesol starting material comprises an EE:EZ weight ratio of 70:30.

In further embodiments, the homofarnesol starting material comprises an EE:EZ weight ratio of 69:31.

In some embodiments, the homofarnesol starting material consists of or consists essentially of a mixture of the four isomers EE:EZ:ZZ:ZE which corresponds with (3E,7E) and (3Z,7E), (3Z,7Z) and (3E,7Z).

In some embodiments, preferably the homofarnesol starting material consists of or consists essentially of a mixture of the isomers selected from one of more of the following groups: [(3Z,7Z), (3E,7Z), (3Z,7E) and (3E,7E)], [(3Z,7E) and (3E,7E)], [(3Z,7E), (3E,7Z)] and/or [(3E,7E) and (3E, 7Z)].

Preferably the homofarnesol starting material consists of or consists essentially of a mixture of the isomers selected from one or more of the following groups: [(3E,7E), (3Z, 7E)] and/or [(3Z,7E), (3E,7E) and (3E,7Z)].

Accordingly, in certain embodiments, ratio of EEH:EZH isomers consists of or consists essentially of a ratio of EEH:EZH of about 100:00; 99:01; 98:02; 97:03; 96:04; 95:05; 94:06; 93:07; 92:08; 91:09; 90:10; 89:11; 88:12; 87:13; 86:14; 85:15; 84:16; 83:17; 82:18; 81:19; 80:20; 79:21; 78:22; 77:23; 76:24; 75:25; 74:26; 73:27; 72:28; 71:29; 70:30; 69:31; 68:32; 67:33; 66:34; 65:35; 64:36; 63:37; 62:38; 61:39; 60:40; 59:41; 58:42; 57:43; 56:44; 55:45; 54:46; 53:47; 52:48; 51:49; or about 50:50.

In some embodiments preferably the homofarnesol starting materials consists of or consists essentially of >90% E,E-homofarnesol (EEH).

In other embodiments, the homofarnesol starting material consists of or consists essentially of an EE:EZ weight ratio of 86:14.

In certain embodiments, the homofarnesol starting material consists of or consists essentially of an EE:EZ weight ratio of 80:20.

In certain embodiments, the homofarnesol starting material consists of or consists essentially of an EE:EZ weight ratio of 70:30.

In further embodiments, the homofarnesol starting material consists of or consists essentially of an EE:EZ weight ratio of 69:31.

In embodiments of the present disclosure, Ambrox is produced using an SHC/HAC derivative enzyme.

SHC/HAC Derivative

As used herein, the term "SHC/HAC Derivative" means that the amino acid sequence of the SHC/HAC Derivative is a modified or variant amino acid sequence which is altered compared to the amino acid sequence of the reference (or wild-type) SHC sequence according to at least SEQ ID No. 1 or SEQ ID No. 2 or SEQ ID No. 3 or SEQ ID No. 4. Generally SHC/HAC derivatives comprise altered forms of SHC having at least one alteration that modifies (eg. increases) the activity of the enzyme for its substrate (eg. EEH).

The SHC/HAC Derivatives of the present disclosure are tested for their homofarnesol Ambrox cyclase activity. Consequently, these SHC/HAC Derivatives which convert homofarnesol to Ambrox are referred to herein as HAC Derivatives as well as SHC Derivatives. Whilst exemplary SHC/HAC derivatives have been provided for enzymes derived from *Alicyclobacillus acidocaldarius, Zymomonas mobilis, Bradyrhizobium japonicum* microbial strain sources, the present disclosure also covers equivalent SHC/HAC derivatives from other microbial strain sources which include but are not limited to SHC/HAC enzymes from *Methylococcus capsulatus, Frankia alni, Acetobacter pasteurianum* and *Tetrahymena pyriformis* (see for example, WO 2010/139719, US2012/01345477, WO 2012/066059, and Tables 10-12).

As used herein, the term "amino acid alteration" means an insertion of one or more amino acids between two amino acids, a deletion of one or more amino acids or a substitution (which may be conservative or non-conservative) of one or more amino acids with one or more different amino acids relative to the amino acid sequence of a reference amino acid sequence (such as, for example, the wild-type (WT) amino acid sequence of SEQ ID No. 1 or SEQ ID No. 2 or SEQ ID No. 3 or SEQ ID No. 4). The amino acid alterations can be easily identified by a comparison of the amino acid sequences of the SHC/HAC derivative amino acid sequence with the amino acid sequence of the reference amino acid sequence (such as, for example, the wild-type (WT) amino acid sequence of SEQ ID No. 1 or SEQ ID No. 2 or SEQ ID No. 3 or SEQ ID No. 4). Exemplary WT SHC amino acid sequence alignments are provided in FIGS. 1-4 and Tables 18 and 19.

Conservative amino acid substitutions may be made, for instance, on the basis of similarity in polarity, charge, size, solubility, hydrophobicity, hydrophilicity, and/or the amphipathic nature of the amino acid residues involved. The 20 naturally occurring amino acids as outlined above can be grouped into the following six standard amino acid groups:

(1) hydrophobic: Met, Ala, Val, Leu;

(2) neutral hydrophilic: Cys, Ser, Thr; Asn, Gln;

(3) acidic: Asp, Glu;

(4) basic: His, Lys, Arg;

(5) residues that influence chain orientation: Gly, Pro; and (6) aromatic: Trp, Tyr, Phe.

Accordingly, as used herein, the term "conservative substitutions" means an exchange of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt alphahelices. Some preferred conservative substitutions within the above six groups are exchanges within the following sub-groups: (i) Ala, Val, Leu and Ile; (ii) Ser and Thr; (ii) Asn and Gin; (iv) Lys and Arg; and (v) Tyr and Phe. Given the known genetic code, and recombinant and synthetic DNA techniques, the skilled scientist readily can construct DNAs encoding the conservative amino acid variants.

As used herein, "non-conservative substitutions" or "non-conservative amino acid exchanges" are defined as exchanges of an amino acid by another amino acid listed in a different group of the six standard amino acid groups (1) to (6) as shown above.

Typically the SHC/HAC Derivatives of the present disclosure are prepared using non-conservative substitutions which alter the biological function (eg. HAC activity) of the disclosed SHC/HAC derivatives.

For ease of reference, the one-letter amino acid symbols recommended by the

IUPAC-IUB Biochemical Nomenclature Commission are indicated as follows. The three letter codes are also provided for reference purposes.

| One Letter Code | Three Letter Code | Amino acid name |
|---|---|---|
| A | Ala | Alanine |
| C | Cys | Cysteine |
| D | Asp | Aspartic Acid |
| E | Glu | Glutamic Acid |
| F | Phe | Phenylalanine |
| G | Gly | Glycine |
| H | His | Histidine |
| I | Ile | Isoleucine |
| K | Lys | Lysine |
| L | Leu | Leucine |
| M | Met | Methionine |
| N | Asn | Asparagine |
| P | Pro | Proline |
| Q | Gln | Glutamine |
| R | Arg | Arginine |
| S | Ser | Serine |
| T | Thr | Threonine |
| V | Val | Valine |
| W | Trp | Tryptophan |
| Y | Tyr | Tyrosine |

Amino acid alterations such as amino acid substitutions may be introduced using known protocols of recombinant gene technology including PCR, gene cloning, site-directed mutagenesis of cDNA, transfection of host cells, and in-vitro transcription which may be used to introduce such changes to the WT SHC sequence resulting in an SHC/HAC derivative enzyme. The derivatives can then be screened for SHC/HAC functional activity.

SHC/HAC Derivative Enzymes

The present invention provides an SHC/HAC derivative and describes an enzyme with homofarnesol Ambrox cyclase (HAC) activity which comprises an amino acid sequence that has from about 1 to about 50 mutations independently selected from substitutions, deletions, or insertions relative to the amino acid sequence of the reference (or wild-type) SHC sequence according to at least SEQ ID No. 1 or SEQ ID No. 2 or SEQ ID No. 3 or SEQ ID No. 4.

In various embodiments, the mutation or combination of mutations enhances the activity of the SHC/HAC derivative for converting homofarnesol to Ambrox compared to reference SHC enzymes that do not show this deletion/addition. Protein modeling as described herein may be used to guide such substitutions, deletions, or insertions in the SHC reference sequence. For example, a structural model of the SHC amino acid sequence may be created using the coordinates for the AacSHC (as shown, for example in FIGS. 19 and 20). As demonstrated herein, such a homology model is useful for directing improvement of SHC enzymes for converting homofarnesol to (−)-Ambrox.

Thus, in various embodiments, the SHC/HAC derivative may have from about 1 to about 45 mutations, about 1 to about 40 mutations, about 1 to about 35 mutations, about 1 to about 30 mutations, about 1 to about 25 mutations, from about 1 to about 20 mutations, about 1 to about 15 mutations, about 1 to about 10 mutations, or from about 1 to about 5 mutations relative to the amino acid sequence of the reference (or wild-type) SHC sequence according to at least SEQ ID No. 1 or SEQ ID No. 2 or SEQ ID No. 3 or SEQ ID No. 4.

In various embodiments, the SHC/HAC derivative comprises a sequence having at least 5 or at least 10 mutations relative to the amino acid sequence of the reference (or wild-type) SHC sequence according to at least SEQ ID No. 1 or SEQ ID No. 2 or SEQ ID No. 3 or SEQ ID No. 4 but not more than about 20 or 30 mutations. In various embodiments, the SHC derivative may have about 1 mutation, about 2 mutations, about 3 mutations, about 4 mutations, about 5 mutations, about 6 mutations, about 7 mutations, about 8 mutations, about 9 mutations, about 10 mutations, about 11 mutations, about 12 mutations, about 13 mutations, about 14 mutations, about 15 mutations, about 16 mutations, about 17 mutations, about 18 mutations, about 19 mutations, about 20 mutations, about 21 mutations, about 22 mutations, about 23 mutations, about 24 mutations, about 25 mutations, about 26 mutations, about 27 mutations, about 28 mutations, about 29 mutations, about 30 mutations, about 31 mutations, about 32 mutations, about 33 mutations, about 34 mutations, about 35 mutations, about 36 mutations, about 37 mutations, about 38 mutations, about 39 mutations, about 40 mutations, about 41 mutations, about 42 mutations, about 43 mutations, about 44 mutations, about 45 mutations, about 46 mutations, about 47 mutations, about 48 mutations, about 49 mutations, or about 50 mutations relative to the reference SHC (such as, for example, SEQ ID No. 1 or 2 or 3 or 4).

In these or other embodiments, the SHC/HAC derivative may comprise an amino acid sequence having at least about 50% sequence identity, at least about 55% sequence identity, at least about 60% sequence identity, at least about 65% sequence identity, at least about 70% sequence identity, at least about 75% sequence identity, at least about 80% sequence identity, at least about 85% sequence identity, or at least 90% sequence identity, or at least 91% sequence identity, or at least 92% sequence identity, or at least 93% sequence identity, or at least 94% sequence identity, or at least 95% sequence identity, or at least 96% sequence identity, or at least 97% sequence identity, or at least 98% sequence identity, or at least 99% sequence identity, to WT SHC (such as, for example, SEQ ID No. 1 or SEQ ID No. 2 or SEQ ID No. 3 or SEQ ID No. 4) or between the reference sequences (see for example Tables 18 and 19 where at least 34-52% identity between AacSHC (SEQ ID No. 1) and other SHC sequences (eg. ZmoSHC of WO 2010/139719 is demonstrated).

In various embodiments, the SHC variant has higher activity for converting homofarnesol to Ambrox than the wild-type enzyme, such as a higher production of (−)-Ambrox upon contact with a homofarnesol substrate than the reference wild-type enzyme (such as, for example, SEQ ID No. 1 or SEQ ID No. 2 or SEQ ID No. 3 or SEQ ID No. 4).

For example, the SHC/HAC derivative may comprise an amino acid sequence having at least: about 50% identity, about 51% identity, about 52% identity, about 53% identity, about 54% identity, about 55% identity, about 56% identity, about 57% identity, about 58% identity, about 59% identity, about 60% identity, about 61% identity, about 62% identity, about 63% identity, about 64% identity, about 65% identity, about 66% identity, about 67% identity, about 68% identity, about 69% identity, about 70% identity, about 71% identity, about 72% identity, about 73% identity, about 74% identity, about 75% identity, about 76% identity, about 77% identity, about 78% identity, about 79% identity, about 80% identity, about 81% identity, about 82% identity, about 83% identity, about 84% identity, about 85% identity, about 86% identity, about 87% identity, about 88% identity, about 89% identity, about 90% identity, about 91% sequence identity, about 92% sequence identity, about 93% sequence identity, about 94% sequence identity, about 95% sequence identity, about 96% sequence identity, about 97% sequence identity, about 98% sequence identity, or about 99% sequence identity to the reference SHC (such as, for example SEQ ID No. 1 or 2 or 3 or 4) or between the reference sequences (see for example Tables 18 and 19 where at least 34-52% identity between AacSHC (SEQ ID No. 1) and other SHC sequences (eg. ZmoSHC of WO 2010/139719) is demonstrated.

Various SHC/HAC derivatives which have been tested for SHC enzyme activity are listed in one or more of Tables 1-9. Thus, in various embodiments, the SHC/HAC derivative may have at least about 1, at least about 2, at least about 3, at least about 4, at least about 5, at least about 6, at least about 7, at least about 8, at least about 9, or at least about 10 mutations selected from one or more of Tables 1-9. In some embodiments, the SHC/HAC derivative is a modified SHC polypeptide comprising an amino acid sequence which has up to 4 mutations compared to the wild-type/reference amino acid sequence according to SEQ ID No. 1 and comprises at least the substitutions F601Y or M132R in combination with at least any one or more of F129L and/or I432T relative to SEQ ID No. 1 and optionally comprises a leader sequence supporting expression and activity in E. coli.

In other embodiments, the SHC/HAC derivative is a modified SHC polypeptide comprising an amino acid sequence which has up to 8 mutations compared to the wild-type/reference amino acid sequence according to SEQ ID No. 1 (or its counterpart that is modified for expression in E. coli) and comprises one or more one amino acid alteration in a position selected from the group consisting of positions 77, 92, 129, 132, 224, 432, 579, 601 and 605 relative to SEQ ID No. 1 wherein the SHC/HAC derivative has an modified (eg. increased) enzymatic activity relative to SEQ ID No. 1.

In one embodiment, the SHC derivative comprises one or more substitutions selected from the group of mutants consisting of: T77X, I92X, F129X, M132X, A224X, I432X, Q579X, F601Y, and F605W relative to SEQ ID No. 1 wherein:
T77X has X selected from: A, C, D, E, F, G, H, I, K, L, M, N, P, Q, R, S, T, V, W or Y.
I92X has X selected from: A, C, D, E, F, G, H, I, K, L, M, N, P, Q, R, S, T, V, W or Y.
F129X has X selected from: A, C, D, E, F, G, H, I, K, L, M, N, P, Q, R, S, T, V, W or Y.
M132X has X selected from: A, C, D, E, F, G, H, I, K, L, M, N, P, Q, R, S, T, V, W or Y.
A224X has X selected from: A, C, D, E, F, G, H, I, K, L, M, N, P, Q, R, S, T, V, W or Y.
I432X has X selected from: A, C, D, E, F, G, H, I, K, L, M, N, P, Q, R, S, T, V, W or Y.
Q579X has X selected from: A, C, D, E, F, G, H, I, K, L, M, N, P, Q, R, S, T, V, W or Y.
F601X has X selected from: A, C, D, E, F, G, H, I, K, L, M, N, P, Q, R, S, T, V, W or Y.
F605X has X selected from: A, C, D, E, F, G, H, I, K, L, M, N, P, Q, R, S, T, V, W or Y.

In one embodiment, the SHC derivative comprises one or more substitutions selected from the group of mutants consisting of: T77A, I92V, F129L, M132R, A224V, I432T, Q579H, F601Y and F605W relative to SEQ ID No. 1.

In another embodiment, the SHC derivative comprises one or more substitutions selected from the group of mutants consisting of: S129X, V145X, F182X, Y185X, G282X, I498X, H646X, and F698X relative to SEQ ID No. 2 wherein:
S129X has X selected from: A, C, D, E, F, G, H, I, K, L, M, N, P, Q, R, S, T, V, W or Y.
V145X has X selected from: A, C, D, E, F, G, H, I, K, L, M, N, P, Q, R, S, T, V, W or Y.
F182X has X selected from: A, C, D, E, F, G, H, I, K, L, M, N, P, Q, R, S, T, V, W or Y.
Y185X has X selected from: A, C, D, E, F, G, H, I, K, L, M, N, P, Q, R, S, T, V, W or Y.
G282X has X selected from: A, C, D, E, F, G, H, I, K, L, M, N, P, Q, R, S, T, V, W or Y.
I498X has X selected from: A, B, C, D, E, F, G, H, I, K, L, M, N, P, Q, R, S, T, V, W or Y.
H646X has X selected from: A, C, D, E, F, G, H, I, K, L, M, N, P, Q, R, S, T, V, W or Y.
F668X has X selected from: A, C, D, E, F, G, H, I, K, L, M, N, P, Q, R, S, T, V, W or Y.
F698X has X selected from: A, C, D, E, F, G, H, I, K, L, M, N, P, Q, R, S, T, V, W or Y.

In one embodiment, the SHC derivative comprises one or more substitutions selected from the group of mutants consisting of: S129A, V145V, F182L, Y185R, G282V, I498T, H646H, F668Y and F698X relative to SEQ ID No. 2 as set out in Table 2.

In a further embodiment, the SHC derivative comprises one or more substitutions selected from the group of mutants consisting of: G85X, V100X, F137X, I140X, V233X, I450X, N598X, F620X and F624X relative to SEQ ID No. 3 wherein:
G85X has X selected from: A, C, D, E, F, G, H, I, K, L, M, N, P, Q, R, S, T, V, W or Y.
V100X has X selected from: A, C, D, E, F, G, H, I, K, L, M, N, P, Q, R, S, T, V, W or Y.
F137X has X selected from: A, C, D, E, F, G, H, I, K, L, M, N, P, Q, R, S, T, V, W or Y.
I140X has X selected from: A, C, D, E, F, G, H, I, K, L, M, N, P, Q, R, S, T, V, W or Y.
V233X has X selected from: A, C, D, E, F, G, H, I, K, L, M, N, P, Q, R, S, T, V, W or Y.
I450X has X selected from: A, C, D, E, F, G, H, I, K, L, M, N, P, Q, R, S, T, V, W or Y.
N598X has X selected from: A, C, D, E, F, G, H, I, K, L, M, N, P, Q, R, S, T, V, W or Y.
F620X has X selected from: A, C, D, E, F, G, H, I, K, L, M, N, P, Q, R, S, T, V, W or Y.
F624X has X selected from: A, C, D, E, F, G, H, I, K, L, M, N, P, Q, R, S, T, V, W or Y.

In one embodiment, the SHC derivative comprises one or more substitutions selected from the group of mutants consisting of: G85A, V100V, F137L, I140R, V233V, I450T, N598H, F620Y and F624W relative to SEQ ID No. 3 as set out in Table 3 and Table 3a.

In a further embodiment, the SHC derivative comprises one or more substitutions selected from the group of mutants consisting of: A88X, V104X, F141X, Y144X, V241X, I459X, M607X, F628X and F658X relative to SEQ ID No. 4 wherein:
A88X has X selected from: A, C, D, E, F, G, H, I, K, L, M, N, P, Q, R, S, T, V, W or Y.
V104X has X selected from: A, C, D, E, F, G, H, I, K, L, M, N, P, Q, R, S, T, V, W or Y.
F141X, has X selected from: A, C, D, E, F, G, H, I, K, L, M, N, P, Q, R, S, T, V, W or Y.
Y144X has X selected from: A, C, D, E, F, G, H, I, K, L, M, N, P, Q, R, S, T, V, W or Y.
V241X has X selected from: A, C, D, E, F, G, H, I, K, L, M, N, P, Q, R, S, T, V, W or Y.
I459X has X selected from: A, C, D, E, F, G, H, I, K, L, M, N, P, Q, R, S, T, V, W or Y.
M607X has X selected from: A, C, D, E, F, G, H, I, K, L, M, N, P, Q, R, S, T, V, W or Y.

F628X has X selected from: A, C, D, E, F, G, H, I, K, L, M, N, P, Q, R, S, T, V, W or Y.
F658X has X selected from: A, C, D, E, F, G, H, I, K, L, M, N, P, Q, R, S, T, V, W or Y.

In a further embodiment, the SHC derivative comprises one or more substitutions selected from the group consisting of: A88A, V104V, F141L, Y144R, V241V, I459T, M607H, F628Y and F658W relative to SEQ ID No. 4 as set out in Table 4.

SHC Derivative Combinations

In one embodiment, the SHC derivative comprises one or more substitutions selected from the group of mutants consisting of: T77A, F129L, M132R, I92V, A224V, I432T, Q579H, and F601Y relative to SEQ ID No. 1 as set out in Table 5.

In one embodiment, the SHC derivatives comprise one or more substitutions selected from the group of mutants consisting of: S129A, V145V F182L, Y185R, G282V, I498T, H646H and F668Y relative to SEQ ID No. 2 as set out in Table 6.

In one embodiment, the SHC derivatives comprise one or more substitutions selected from the group of mutants consisting of: G85A, V100V F137L, I140R, V233V, I450T, N598H, and F620Y relative to SEQ ID No. 3 as set out in Table 7.

In a further embodiment, the SHC derivative comprises one or more substitutions selected from the group consisting of: A88A, V104V, F141L, Y144R, V241V, I459T, M607H, and F628Y relative to SEQ ID No. 4 as set out in Table 8.

TABLE 3

Summary of SHC mutations numbered relative to wild-type AacSHC (SEQ ID No. 1) and the sequence alignment of AacSHC with ZmoSHC2 (Seitz et al 2012 - as cited above) Supplementary Data Sheet

| No. | Position and AA in WT AacSHC (SEQ ID No. 1) | | AA and position in ZmoSHC2 (SEQ ID No. 3) | | Mutation | AA in SEQ ID No. (see Table 16) |
|---|---|---|---|---|---|---|
| 1 | 77 | T | G | 85 | A | 77 |
| 8 | 92 | I | V | 100 | V | 79 |
| 2 | 129 | F | F | 137 | L | 81 |
| 3 | 132 | M | I | 140 | R | 83 |
| 4 | 224 | A | V | 233 | V | 85 |
| 5 | 432 | I | I | 450 | T | 87 |
| 6 | 579 | Q | N | 598 | H | 89 |
| 7 | 601 | F | F | 620 | Y | 91 |
| 9 | 605 | F | F | 624 | W | 175 |

TABLE 1

Summary of SHC mutations numbered relative to wild-type AacSHC (SEQ ID No. 1) and FIG. 1 from Hoshino and Sato (2002 as cited above)

| No. | Position in WT AacSHC | Location | Amino Acid (AacSHC) (SEQ ID No. 1) | Amino Acid (ZmoSHC) (Hoshino and Sato 2002) | Amino Acid (*H. sapiens*) (Hoshino and Sato 2002) | Mutation | Amino Acid in SEQ ID No. (Table 14) |
|---|---|---|---|---|---|---|---|
| 1 | 77 | QW5c-QW5b | T | G | G | A | 5 |
| 8 | 92 | QW5c-QW5b | I | V | A | V | 7 |
| 2 | 129 | QW5c-QW5b | F | F | W | L | 9 |
| 3 | 132 | QW5c-QW5b | M | I | F | R | 11 |
| 4 | 224 | QW5c-QW5b | A | V | V | V | 13 |
| 5 | 432 | QW4-QW3 | I | I | N | T | 15 |
| 6 | 579 | QW1 | Q | N | R | H | 17 |
| 7 | 601 | QW1 | F | F | F | Y | 19 |
| 9 | 605 | | F | F | F | W | 171 |

TABLE 2

Summary of SHC mutations numbered relative to wild-type AacSHC (SEQ ID No. 1) and the sequence alignment of AacSHC with ZmoSHC1 (Seitz et al 2012 - as cited above) Supplementary Data Sheet

| No. | Position and AA in WT AacSHC (SEQ ID No. 1) | | Equivalent AA and position in ZmoSHC1 (SEQ ID No. 2) | | Mutation | AA in SEQ ID No. (see Table 15) |
|---|---|---|---|---|---|---|
| 1 | 77 | T | S | 129 | A | 41 |
| 8 | 92 | I | V | 145 | V | 43 |
| 2 | 129 | F | F | 182 | L | 45 |
| 3 | 132 | M | Y | 185 | R | 47 |
| 4 | 224 | A | G | 282 | V | 49 |
| 5 | 432 | I | I | 498 | T | 51 |
| 6 | 579 | Q | H | 647 | H | 53 |
| 7 | 601 | F | F | 668 | Y | 55 |
| 9 | 605 | F | F | 698 | W | 173 |

TABLE 3a

Summary of SHC mutations numbered relative to wild-type AacSHC (SEQ ID No. 1) and the sequence alignment of AacSHC with sequence No. 20 in the SHC Alignment Figure of Merkofer PhD thesis (2004) (see http://elib.uni-stuttgart.de/handle/11682/1400)

| No. | Position and AA in WT AacSHC (SEQ ID No. 1) | | AA in ZmoSHC | Mutation |
|---|---|---|---|---|
| 1 | 77 | T | G | A |
| 8 | 92 | I | V | V |
| 2 | 129 | F | F | L |
| 3 | 132 | M | I | R |
| 4 | 224 | A | V | V |
| 5 | 432 | I | I | T |
| 6 | 579 | Q | N | H |
| 7 | 601 | F | F | Y |
| 9 | 605 | F | F | W |

TABLE 4

Summary of SHC mutations numbered relative to wild-type AacSHC (SEQ ID No. 1) and the sequence alignment of AacSHC with BjpSHC (SEQ ID No. 5 in WO 2010/139719)

| No. | Position and AA in WT AacSHC (SEQ ID No. 1) | | AA and position in WT BjpSHC (SEQ ID No. 4) | | Mutation | AA in SEQ ID No. (see Table 17) |
|---|---|---|---|---|---|---|
| 1 | 77 | T | A | 88 | A | 113 |
| 8 | 92 | I | V | 104 | V | 115 |
| 2 | 129 | F | F | 141 | L | 117 |
| 3 | 132 | M | Y | 144 | R | 119 |
| 4 | 224 | A | V | 241 | V | 121 |
| 5 | 432 | I | I | 459 | T | 123 |
| 6 | 579 | Q | M | 607 | H | 125 |
| 7 | 601 | F | F | 628 | Y | 127 |
| 9 | 605 | F | F | 658 | W | 177 |

TABLE 4a

Using the sequence alignments provided in Tables 21a-21j where WTAacSHC (SEQ ID No. 1) is aligned with any one of SEQ ID No. 149, 151, 153, 155, 157, 159 (as identified below), the AA residue and positions corresponding to T77, I92, F129, M132, A224, I432, Q579 and F601 in WT AacSHC (SEQ ID No. 1) can be identified and tested for SHC/HAC activity

| Amino Acid SEQ ID No. | Strain | SEQ ID No. in WO 2010/0139719 (nucleotide/ amino acid sequences) | Nucleotide/ amino acid SEQ ID No. |
|---|---|---|---|
| SEQ ID No. 149 | Burkholderia ambifaria6 | SEQ ID No. 6 | 150 |
| SEQ ID No. 151 | Burkholderia ambifaria | SEQ ID No. 7 | 152 |
| SEQ ID No. 153 | Bacillus anthracis | SEQ ID No. 8 | 154 |
| SEQ ID No. 155 | Frankia alni | SEQ ID No. 9 | 156 |
| SEQ ID No. 157 | Rhodopseudomonas palent | SEQ ID No. 10 | 158 |
| SEQ ID No. 159 | Streptomyces coelicolor | SEQ ID No. 11 | 160 |
| SEQ ID No. 161 | Zymomonas mobilis2 | SEQ ID No. 2 | 162 |
| SEQ ID No. 163 | Zymomonas mobilis | SEQ ID No. 1 | 164 |
| SEQ ID No. 4 | Bradyrhizobium japonicum5 | SEQ ID No. 5 | 168 |

TABLE 5

Summary of SHC mutations combinations numbered according to wild-type AacSHC (SEQ ID No. 1)

| Mutation combinations in AacSHC (SEQ ID No. 1) | SHC Derivative ID | Number of mutations | Amino acid SEQ ID No. | Nucleotide SEQ ID No. |
|---|---|---|---|---|
| M132R + A224V + I432T | 215G2 | 3 | 21 | 22 |
| M132R + I432T | SHC26 | 2 | 23 | 24 |
| F601Y | SHC3 | 1 | 25 | 26 |
| T77A + I92V + F129L | 111C8 | 3 | 27 | 28 |
| Q579H + F601Y | 101A10 | 2 | 29 | 30 |
| F129L | SHC10 | 1 | 31 | 32 |
| F129L + F601Y | SHC30 | 2 | 33 | 34 |
| F129L + M132R + I432T | SHC31 | 3 | 35 | 36 |
| M132R + I432T + F601Y | SHC32 | 3 | 37 | 38 |
| F129L + M132R + I432T + F601Y | SHC33 | 4 | 39 | 40 |

TABLE 6

Summary of SHC mutations combinations numbered according to wild-type ZmoSHC1 sequence (SEQ ID No. 2)

| Mutation combinations in ZmoSHC1 (SEQ ID No. 2) | SHC Derivative ID | Number of mutations | Amino acid SEQ ID No. | Nucleotide SEQ ID No. |
|---|---|---|---|---|
| Y185R + G282V + I498T | 215G2ZM1 | 3 | 57 | 58 |
| Y185R + I498T | SHC26 ZM1 | 2 | 59 | 60 |
| F668Y | SHC3 ZM1 | 1 | 61 | 62 |
| S129A + V145V + F182L | 111C8 ZM1 | 3 | 63 | 64 |
| H646H + F668Y | 101A10 ZM1 | 2 | 65 | 66 |
| F182L | SHC10 ZM1 | 1 | 67 | 68 |
| F182L + F668Y | SHC30 ZM1 | 2 | 69 | 70 |
| F182L + Y185R + I498T | SHC31 ZM1 | 3 | 71 | 72 |
| Y185R + I498T + F668Y | SHC32 ZM1 | 3 | 73 | 74 |
| F182L + Y185R + I498T + F668Y | SHC33 ZM1 | 4 | 75 | 76 |

TABLE 7

Summary of SHC mutations combinations numbered according to wild-type ZmoSHC2 sequence (SEQ ID No. 3)

| Mutation combinations in ZmoSHC2 (SEQ ID No. 3) | SHC Derivative ID | Number of mutations | Amino acid SEQ ID No. | Nucleotide SEQ ID No. |
|---|---|---|---|---|
| I140R + V233V + I450T | 215G2 ZM2 | 3 | 93 | 94 |
| I140R + I450T | SHC26 ZM2 | 2 | 95 | 96 |
| F620Y | SHC3 ZM2 | 1 | 97 | 98 |
| G85A + V100V + F137L | 111C8 ZM2 | 3 | 99 | 100 |
| N598H + F620Y | 101A10 ZM2 | 2 | 101 | 102 |
| F137L | SHC10 ZM2 | 1 | 103 | 104 |
| F137L + F620Y | SHC30 ZM2 | 2 | 105 | 106 |
| F137L + I140R + I450T | SHC31 ZM2 | 3 | 107 | 108 |
| I140R + I450T + F620Y | SHC32 ZM2 | 3 | 109 | 110 |
| F137L + I140R + I450T + F620Y | SHC33 ZM2 | 4 | 111 | 112 |

TABLE 8

Summary of SHC mutations combinations numbered according to wild-type BjpSHC (SEQ ID No. 4)

| Mutation combinations in BjpSHC (SEQ ID No. 4) | SHC Derivative ID | Number of mutations | Amino acid SEQ ID No. | Nucleotide SEQ ID No. |
|---|---|---|---|---|
| Y144R + V241V + I459T | 215G2 Bjp | 3 | 129 | 130 |
| Y144R + I459T | SHC26 BjP | 2 | 131 | 132 |
| F628Y | SHC3 Bjp | 1 | 133 | 134 |
| A88A + V104V + F141L | 111C8 Bjp | 3 | 135 | 136 |
| M607H + F628Y | 101A10 Bjp | 2 | 137 | 138 |
| F141L | SHC10 Bjp | 1 | 139 | 140 |
| F141L + F628Y | SHC30 Bjp | 2 | 141 | 142 |
| F141L + Y144R + I459T | SHC31 Bjp | 3 | 143 | 144 |
| M144R + I459T + F628Y | SHC32 Bjp | 3 | 145 | 146 |
| F141L + Y144R + I459T + F628Y | SHC33 Bjp | 4 | 147 | 148 |

TABLE 9

Showing the common SHC mutations relative to the WT AacSHC (SEQ ID No. 1), WT ZmoSHC1 (SEQ ID No. 2), WT ZmoSHC2 (SEQ ID No. 3) and BjpSHC (SEQ ID No. 4)

| Mutation Combinations | | | | |
|---|---|---|---|---|
| in AacSHC (SEQ ID No. 1) | Relative to ZmoSHC1 (SEQ ID No. 2) | Relative to ZmoSHC2 (SEQ ID No. 3) | Relative to BjpSHC (SEQ ID No. 4) | SHC Derivative |
| F601Y | F668Y | F620Y | F628Y | SHC3 |
| F129L | F182L | F137L | F141L | SHC10 |
| F601Y + F129L | F668Y + F182L | F620Y + F137L | F628Y + F141L | SHC30 |
| F601Y + M132R + I432T | F668Y + Y185R + I498T | F620Y + I140R + I450T | F628Y + Y144R + I459T | SHC32 |
| F601Y + F129L + M132R + I432T | F668Y + F182L + Y185R + I498T | F620Y + F137L + I140R + I450T | F628Y + F141L + Y144R + I459T | SHC33 |
| M132R + I432T | Y185R + I498T | I140R + I450T | Y144R + I459T | SHC26 |
| M132R + I432T + A224V | Y185R + I498T + G282V | I140R + I450T + V233V | Y144R + I459T + V241V | 215G2 |
| M132R + I432T + F129L | Y185R + I498T + F182L | I140R + I450T + F137L | Y144R + I459T + F141L | SHC31 |

In a preferred embodiment, the SHC derivative comprises at least the substitutions F601Y or M132R in combination with at least any one or more of F129L and/or I432T relative to SEQ ID No. 1.

The SHC derivative termed SHC3 which is provided in the present disclosure comprises the following substitution F601Y as compared with the reference SHC protein (SEQ ID No. 1).

Hoshino and Sato (2002 as cited above) identified F601 as a highly conserved amino acid residue among the prokaryotic and eukaryotic species. It is reported that SHC derivative F601Y showed a greatly increased Vmax for an oxidosqualene substrate (not squalene). However F601Y shows a decrease in affinity (i.e. a higher $K_M$) and a decrease in catalytic efficiency/activity ($Kcat/K_M$) relative to the WT AacSHC when squalene is used. No data is provided in Hoshino and Sato (2002 as cited above) on AacSHC efficacy when homofarnesol is used as the enzyme substrate with the F601Y mutant.

The SHC derivative termed SHC10 which is provided in the present disclosure com-prises the following substitution F129L as compared with the reference SHC protein (SEQ ID No. 1).

The SHC derivative termed SHC30 which is provided in the present disclosure comprises the following substitution F601Y and F129L as compared with the reference SHC protein (SEQ ID No. 1).

The SHC derivative termed SHC26 which is provided in the present disclosure comprises the following substitution M132R and I432T as compared with the reference SHC protein (SEQ ID No. 1).

The SHC derivative termed 215G2 which is provided in the present disclosure comprises the following substitution M132R, I432T and A224V as compared with the reference SHC protein (SEQ ID No. 1).

The SHC derivative termed SHC32 which is provided in the present disclosure comprises the following substitution F601Y, M132R and I432T as compared with the reference SHC protein (SEQ ID No. 1).

The SHC derivative termed SHC31 which is provided in the present disclosure comprises the following substitution F129L, M132R and I432T as compared with the reference SHC protein (SEQ ID No. 1).

The SHC derivative termed SHC33 which is provided in the present disclosure comprises the following substitution F601Y, F129L, M132R and I432T as compared with the reference SHC protein (SEQ ID No. 1).

The SHC derivative termed 101A10 which is provided in the present disclosure comprises the following substitution F601Y and Q579H as compared with the reference SHC protein (SEQ ID No. 1).

The SHC derivative termed 111C8 which is provided in the present disclosure comprises the following substitution T77A +I92V and F129L as compared with the reference SHC protein (SEQ ID No. 1).

In a preferred embodiment, the SHC derivative comprises at least the substitutions F668Y or Y185R in combination with at least any one or more of F182L and/or I498T relative to SEQ ID No. 2.

The SHC derivative termed SHC3ZM1 which is provided in the present disclosure comprises the following substitution F668Y as compared with the reference SHC protein (SEQ ID No. 2).

Hoshino and Sato (2002 as cited above) identified F601 as a highly conserved amino acid residue among the prokaryotic and eukaryotic species. It is reported that SHC derivative F601Y showed a greatly increased Vmax for a oxidosqualene substrate (not squalene). However F601Y shows a decrease in affinity (i.e. a higher $K_M$) and a decrease in catalytic efficiency/activity ($Kcat/K_M$) relative to the WT AacSHC when squalene is used. No data is provided in Hoshino and Sato on AacSHC efficacy when Homofarnesol is used as the enzyme substrate with the F601Y mutant. The SHC derivative equivalent to F601Y in ZmoSHC1 is F668Y.

The SHC derivative termed SHC10ZM1 which is provided in the present disclosure comprises the following substitution F182L as compared with the reference SHC protein (SEQ ID No. 2).

The SHC derivative termed SHC30ZM1 which is provided in the present disclosure comprises the following substitution F668Y and F182L as compared with the reference SHC protein (SEQ ID No. 2).

The SHC derivative termed SHC26ZM1 which is provided in the present disclosure comprises the following substitution Y185R and I498T as compared with the reference SHC protein (SEQ ID No. 2).

The SHC derivative termed 215G2ZM1 which is provided in the present disclosure comprises the following substitution Y185R, I498T and G282V as compared with the reference SHC protein (SEQ ID No. 2).

The SHC derivative termed SHC32ZM1 which is provided in the present disclosure comprises the following substitution F668Y, Y185R and I498T as compared with the reference SHC protein (SEQ ID No. 2).

The SHC derivative termed SHC31ZM1 which is provided in the present disclosure comprises the following substitution F182L, Y185R and I498T as compared with the reference SHC protein (SEQ ID No. 2).

The SHC derivative termed SHC33ZM1 which is provided in the present disclosure comprises the following substitution F668Y, F182L, Y185R and I498T as compared with the reference SHC protein (SEQ ID No. 2).

The SHC derivative termed 101A10ZM1 which is provided in the present disclosure comprises the following substitution F668Y and H646H as compared with the reference SHC protein (SEQ ID No. 2).

The SHC derivative termed 111C8ZM1 which is provided in the present disclosure comprises the following substitution S129A+V145V and F182L as compared with the reference SHC protein (SEQ ID No. 2).

In a preferred embodiment, the SHC derivative comprises at least the substitutions F620Y or I140R in combination with at least any one or more of F137L and/or I450T relative to SEQ ID No. 3.

The SHC derivative termed SHC3ZM2 which is provided in the present disclosure comprises the following substitution F620Y as compared with the reference SHC protein (SEQ ID No. 3).

Hoshino and Sato (2002 as cited above) identified F601 as a highly conserved amino acid residue among the prokaryotic and eukaryotic SHC species. It was reported that AacSHC derivative F601Y showed a greatly increased Vmax for a oxidosqualene substrate (not squalene). However F601Y shows a decrease in affinity (i.e. a higher $K_M$) and a decrease in catalytic efficiency/activity ($Kcat/K_M$) relative to the WT AacSHC when squalene is used. No data is provided in Hoshino and Sato (2002) on AacSHC efficacy when Homofarnesol is used as the enzyme substrate with the F601Y mutant. The SHC derivative equivalent to F601Y in ZmoSHC2 is F620Y.

The SHC derivative termed SHC10ZM2 which is provided in the present disclosure comprises the following substitution F137L as compared with the reference SHC protein (SEQ ID No. 3).

The SHC derivative termed SHC30ZM2 which is provided in the present disclosure comprises the following substitution F620Y and F137L as compared with the reference SHC protein (SEQ ID No. 3).

The SHC derivative termed SHC26ZM2 which is provided in the present disclosure comprises the following substitution I140R and I450T as compared with the reference SHC protein (SEQ ID No. 3).

The SHC derivative termed 215G2ZM2 which is provided in the present disclosure comprises the following substitution I140R, I450T and V233V as compared with the reference SHC protein (SEQ ID No. 3).

The SHC derivative termed SHC32ZM2 which is provided in the present disclosure comprises the following substitution F620Y, I140R and I450T as compared with the reference SHC protein (SEQ ID No. 3).

The SHC derivative termed SHC31ZM2 which is provided in the present disclosure comprises the following substitution F137L, I140R and I450T as compared with the reference SHC protein (SEQ ID No. 3).

The SHC derivative termed SHC33 ZM2 which is provided in the present disclosure comprises the following substitution F620Y, F137L, I140R and I450T as compared with the reference SHC protein (SEQ ID No. 3).

The SHC derivative termed 101A10ZM2 which is provided in the present disclosure comprises the following substitution F620Y and N598H as compared with the reference SHC protein (SEQ ID No. 3).

The SHC derivative termed 111C8ZM2 which is provided in the present disclosure comprises the following substitution G85A+V100V and F137L as compared with the reference SHC protein (SEQ ID No. 3).

In a preferred embodiment, the SHC derivative comprises at least the substitutions F628Y or Y144R in combination with at least any one or more of F141L and/or I459T relative to SEQ ID No. 4.

The SHC derivative termed SHC3Bjp which is provided in the present disclosure comprises the following substitution F628Y as compared with the reference SHC protein (SEQ ID No. 4).

Hoshino and Sato (2002 as cited above) identified F601 as a highly conserved amino acid residue among the prokaryotic and eukaryotic species. It is reported that SHC derivative F601Y showed a greatly increased Vmax for a oxidosqualene substrate (not squalene). However F601Y shows a decrease in affinity (i.e. a higher $K_M$) and a decrease in catalytic efficiency/activity ($Kcat/K_M$) relative to the WT AacSHC when squalene is used. No data is provided in Hoshino and Sato on AacSHC efficacy when Homofarnesol is used as the enzyme substrate with the F601Y mutant. The SHC derivative equivalent to F601Y in BjpSHC is F628Y.

The SHC derivative termed SHC10Bjp which is provided in the present disclosure comprises the following substitution F141L as compared with the reference SHC protein (SEQ ID No. 4).

The SHC derivative termed SHC30Bjp which is provided in the present disclosure comprises the following substitution F628Y and F141L as compared with the reference SHC protein (SEQ ID No. 4).

The SHC derivative termed SHC26Bjp which is provided in the present disclosure comprises the following substitution Y144R and I459T as compared with the reference SHC protein (SEQ ID No. 4).

The SHC derivative termed 215G2Bjp which is provided in the present disclosure comprises the following substitution Y144R, I459T and V241V as compared with the reference SHC protein (SEQ ID No. 4).

The SHC derivative termed SHC32Bjp which is provided in the present disclosure comprises the following substitution F628Y, Y144R and I459T as compared with the reference SHC protein (SEQ ID No. 4).

The SHC derivative termed SHC31Bjp which is provided in the present disclosure comprises the following substitution F141L, Y144R and I459T as compared with the reference SHC protein (SEQ ID No. 4).

The SHC derivative termed SHC33Bjp which is provided in the present disclosure comprises the following substitution F628Y, F141L, Y144R and I459T as compared with the reference SHC protein (SEQ ID No. 4).

The SHC derivative termed 101A10Bjp which is provided in the present disclosure comprises the following substitution F628Y and M607H as compared with the reference SHC protein (SEQ ID No. 4).

The SHC derivative termed 111C8Bjp which is provided in the present disclosure comprises the following substitution A88A +V104V and F141L as compared with the reference SHC protein (SEQ ID NO: 4).

Amino Acid Sequences

In some embodiments, the AacSHC/HAC derivative comprises one or more of the polypeptides as set out in one or more of SEQ ID No. 5, 7, 9, 11, 13, 15, 17, 19, 21, 23, 25, 27, 29, 31, 33, 35, 37, 39 and/or 171.

Preferably the AacSHC/HAC derivatives of the present disclosure have an amino acid sequence selected from the group consisting of SEQ ID No. 21, SEQ ID No. 23, SEQ ID No. 25 SEQ ID No. 27, SEQ ID No. 29, SEQ ID No. 31, SEQ ID No. 33, SEQ ID No. 35, SEQ ID No. 37, SEQ ID No. 39 and/or SEQ ID No. 171.

In other embodiments, the ZmoSHC1/HAC derivatives comprise one or more of the polypeptides as set out in one or more of SEQ ID No. 41, 43, 45, 47, 49, 51, 53, 55, 57, 59, 61, 63, 65, 67, 69, 71, 73, 75 and/or 173.

Preferably the ZmoSHC1/HAC derivatives of the present disclosure have an amino acid sequence selected from the group consisting of SEQ ID No. 57, SEQ ID No. 59, SEQ ID No. 61, SEQ ID No. 63, SEQ ID No. 65, SEQ ID No. 67, SEQ ID No. 69, SEQ ID No. 71, SEQ ID No. 73, SEQ ID No. 75 and/or SEQ ID No. 173.

In further embodiments, the ZmoSHC2/HAC derivatives comprise one or more of the polypeptides as set out in one or more of SEQ ID No. 77, SEQ ID No. 79, SEQ ID No. 81, SEQ ID No. 83, SEQ ID No. 85, SEQ ID No. 87, SEQ ID No. 89, SEQ ID No. 91, SEQ ID No. 93, SEQ ID No. 95, SEQ ID No. 97, SEQ ID No. 99, SEQ ID No. 101, SEQ ID No. 103, SEQ ID No. 105, SEQ ID No. 107, SEQ ID No. 109, SEQ ID No. 111 and/or SEQ ID No. 175.

In additional embodiments, the BjpSHC/HAC derivatives comprise one or more of the polypeptides as set out in one or more of: SEQ ID No. 113, SEQ ID No. 115, SEQ ID No. 117, SEQ ID No. 119, SEQ ID No. 121, SEQ ID No. 123, SEQ ID No. 125, SEQ ID No. 127, SEQ ID No. 129, SEQ ID No. 131. SEQ ID No. 133, SEQ ID No. 135, SEQ ID No. 137, SEQ ID No. 139, SEQ ID No. 141, SEQ ID No. 143, SEQ ID No. 145, SEQ ID No. 147 and/or SEQ ID No. 177.

Sequence Alignments

Due to the different lengths of SHC reference sequences, such as, for example, the AacSHC, ZmoSHC1, ZmoSHC2 and BjpSHC polypeptides sequences, the amino acid residue at position X of the reference AacSHC sequence (SEQ ID No. 1) corresponds to a different amino acid position B on the ZmoSHC1 reference sequence (SEQ ID No. 2), a different amino acid position J on the ZmoSHC2 reference se-quence (SEQ ID No. 3) and a different amino acid position Z on the BjpSHC reference sequence (SEQ ID No. 4). In addition, the alteration of an SHC reference sequence can also modify the SHC derivative sequence relative that reference SHC sequence.

The term "position" refers to a specific amino acid residue present in the reference SHC protein as identified by the specific numbering of the amino acids. The alteration of the SHC reference protein by either an insertion or a deletion of an amino acid leads to a different numbering between the reference SHC amino acid sequence and the SHC derivative amino acid sequence. By way of example, if an amino acid is inserted between amino acids 509 and 510 of the reference SHC protein, the amino acid following the insertion will have the numbering 511 in the SHC derivative protein while it retains the numbering 510 in the SHC reference protein.

Assays for Determining WT SHC/HAC and SHC/HAC Derivative Activity

Assays for determining and quantifying WT SHC/HAC and/or SHC/HAC derivative enzyme activity are described herein and are known in the art. By way of example, WT SHC/HAC and/or SHC/HAC derivative activity can be determined by incubating purified SHC/HAC enzyme or extracts from host cells or a complete recombinant host organism that has produced the SHC/HAC enzyme with an appropriate substrate under appropriate conditions and carrying out an analysis of the reaction products (eg. by gas chromatography (GC) or HPLC analysis). Further details on SHC/HAC and/or SHC/HAC enzyme activity assays and analysis of the reaction products are provided in the Examples. These assays include producing the SHC derivative in recombinant host cells (eg. E. coli).

As used herein, the term "activity" means the ability of an enzyme to react with a substrate to provide a target product. The activity can be determined in what is known as an activity test via the increase of the target product, the decrease of the substrate (or starting materials) or via a combination of these parameters as a function of time. The SHC/HAC derivatives of the present disclosure are characterized by their ability to bioconvert homofarnesol into (−)-Ambrox and demonstrate a biological activity such as an HAC activity.

A "biological activity" as used herein, refers to any activity a polypeptide may exhibit, including without limitation: enzymatic activity; binding activity to another compound (eg. binding to another polypeptide, in particular binding to a receptor, or binding to a nucleic acid); inhibitory activity (eg. enzyme inhibitory activity); activating activity (eg. enzyme-activating activity); or toxic effects. It is not required that the variant or derivative exhibits such an activity to the same extent as the parent polypeptide. A variant is regarded as a variant within the context of the present application, if it exhibits the relevant activity to a degree of at least 10% of the activity of the parent polypeptide. Likewise, a derivative is regarded as a derivative within the context of the present application, if it exhibits the relevant biological activity to a degree of at least 10% of the activity of the parent polypeptide (as the terms derivative and variant are used interchangeably throughout the present disclosure).

In other embodiments, the SHC/HAC derivatives of the present disclosure show a better target yield than the reference SHC protein. The term "target yield" refers to the gram of recoverable product per gram of feedstock (which can be calculated as a percent molar conversion rate).

In additional embodiments, the SHC/HAC derivatives of the present disclosure show a modified (eg. increased) target productivity relative to the reference SHC protein. The term "target productivity" refers to the amount of recoverable target product in grams per liter of fermentation capacity per hour of bioconversion time (i.e. time after the substrate was added).

In further embodiments, the SHC/HAC derivatives of the present disclosure show a modified target yield factor than the reference SHC protein. The term "target yield factor" refers to the ratio between the product concentration obtained and the concentration of the SHC derivative (for example, purified SHC enzyme or an extract from the recombinant host cells expressing the SHC enzyme) in the reaction medium.

In various embodiments, the SHC derivatives of the present disclosure show a modified (eg. increased) fold increase in enzymatic activity (eg. a modified/increased homofarnesol Ambrox cyclase (HAC) activity) relative to the reference SHC protein (eg. SEQ ID No. 1 or SEQ ID No. 2 or SEQ ID No. 3 or SEQ ID No. 4). This increase in activity is at least by a factor of: 2, 3, 4, 6, 8, 10, 12, 14, 16, 18, 20, 25, 30, 35, 40, 45, 50, 55, 60, 65, 70, 75, 80, 85, 90, 95, and/or 100.

Nucleotide Sequences

The present disclosure further relates to isolated nucleic acid molecules comprising a nucleotide sequence encoding an SHC derivative as described herein.

The term "nucleic acid molecule" as used herein shall specifically refer to polynucleotides of the disclosure which can be DNA, cDNA, genomic DNA, synthetic DNA, or RNA, and can be double-stranded or single-stranded, the sense and/or an antisense strand. The term "nucleic acid molecule" shall particularly apply to the polynucleotide(s) as used herein, eg. as full-length nucleotide sequence or fragments or parts thereof, which encodes a polypeptide with enzymatic activity, eg. an enzyme of a metabolic pathway, or fragments or parts thereof, respectively.

The term also includes a separate molecule such as a cDNA where the corresponding genomic DNA has introns and therefore a different sequence; a genomic fragment that lacks at least one of the flanking genes; a fragment of cDNA or genomic DNA produced by polymerase chain reaction (PCR) and that lacks at least one of the flanking genes; a restriction fragment that lacks at least one of the flanking genes; a DNA encoding a non-naturally occurring protein such as a fusion protein (eg. a His tag), mutein, or fragment of a given protein; and a nucleic acid which is a degenerate variant of a cDNA or a naturally occurring nucleic acid. In addition, it includes a recombinant nucleotide sequence that is part of a hybrid gene, i.e. a gene encoding a non-naturally occurring fusion protein. Fusion proteins can add one or more amino acids (such as but not limited to Histidine (His)) to a protein, usually at the N-terminus of the protein but also at the C-terminus or fused within regions of the protein. Such fuson proteins or fusion vectors encoding such proteins typically serve three purposes: (i) to increase production of recombinant proteins; (ii) to increase the solubility of the recombinant protein; and (iii) to aid in the purification of the recombinant protein by providing a ligand for affinity purification. The term "nucleic acid molecule" also includes codon optimised sequences suitable for expression in a particular microbial host cell (eg. E. coli host cell). As used herein, the term "codon optimized" means a nucleic acid protein coding sequence which has been adapted for expression in a prokaryotic or a eukaryotic host cell, particularly bacterial host cells such as E. coli host cells by substitution of one or more or preferably a significant number of codons with codons that are more frequently used in bacterial (eg. E. coli) host cell genes. In this regard, the nucleotide sequence encoding the reference sequences Sequence ID No. 1, 2, 3 and/or 4 and all variants/derivatives thereof may be the original one as found in the source (eg. AacSHC, ZmoSHC1, ZmoSHC2 or BjpSHC respectively) or the gene can be codon-optimized for the selected host organisms, such as eg. E. coli.

A ribonucleic acid (RNA) molecule can be produced by in vitro transcription. Segments of DNA molecules are also considered within the scope of the disclosure, and can be produced by, for example, the polymerase chain reaction (PCR) or generated by treatment with one or more restriction endonucleases. Segments of a nucleic acid molecule may be referred to as DNA fragments of a gene, in particular those that are partial genes. A fragment can also contain several open reading frames (ORF), either repeats of the same ORF or different ORF's. The term shall specifically refer to coding nucleotide sequences, but shall also include nucleotide sequences which are non-coding, eg. untranscribed or untranslated sequences, or encoding polypeptides, in whole or in part. The genes as used herein, eg. for assembly, diversification or recombination can be non-coding sequences or sequences encoding polypeptides or protein encoding sequences or parts or fragments thereof having sufficient sequence length for successful recombination events. More specifically, said genes have a minimum length of 3 bp, preferably at least 100 bp, more preferred at least 300 bp.

It will be apparent from the foregoing that a reference to an isolated DNA does not mean a DNA present among hundreds to millions of other DNA molecules within, for example, cDNA or genomic DNA libraries or genomic DNA restriction digests in, for example, a restriction digest reaction mixture or an electrophoretic gel slice. An isolated nucleic acid molecule of the present disclosure encompasses segments that are not found as such in the natural state.

As used herein, the term "isolated DNA" can refer to (1) a DNA that contains sequence not identical to that of any naturally occurring sequence, a polynucleotide or nucleic acid which is not naturally occurring, (eg., is made by the artificial combination (eg. artificial manipulation of isolated segments of nucleic acids, eg., by genetic engineering techniques) of two otherwise separated segments of sequences through human intervention) or (2), in the context of a DNA with a naturally-occurring sequence (eg., a cDNA or genomic DNA), a DNA free of at least one of the genes that flank the gene containing the DNA of interest in the genome of the organism in which the gene containing the DNA of interest naturally occurs.

The term "isolated DNA" as used herein, specifically with respect to nucleic acid sequence may also refer to nucleic acids or polynucleotides produced by recombinant DNA techniques, eg. a DNA construct comprising a polynucleotide heterologous to a host cell, which is optionally incorporated into the host cell. A chimeric nucleotide sequence may specifically be produced as a recombinant molecule. The term "recombination" shall specifically apply to assembly of polynucleotides, joining together such polynucleotides or parts thereof, with or without recombination to achieve a cross-over or a gene mosaic. For example, it is performed to join together nucleic acid segments of desired functions to generate a desired combination of functions. A recombinant gene encoding a polypeptide described herein includes the coding sequence for that polypeptide, operably linked, in sense orientation, to one or more regulatory regions suitable for expressing the polypeptide. Because many microorganisms are capable of expressing multiple gene products from a polycistronic mRNA, multiple polypeptides can be expressed under the control of a single regulatory region for those microorganisms, if desired. A coding sequence and a regulatory region are considered to be operably linked when the regulatory region and coding sequence are positioned so that the regulatory region is effective for regulating transcription or translation of the sequence.

The term "recombinant" as used herein, specifically with respect to enzymes shall refer to enzymes produced by recombinant DNA techniques, i.e. produced from cells transformed by an exogenous DNA construct encoding the desired enzyme. "Synthetic" enzymes are those prepared by chemical synthesis. A chimeric enzyme may specifically be produced as recombinant molecule. The term "recombinant DNA" therefore includes a recombinant DNA incorporated into a vector into an autonomously replicating plasmid or virus, or into the genomic DNA of a prokaryote or eukaryote (or the genome of a homologous cell, at a position other than the natural chromosomal location).

In a further aspect the nucleic acid molecule(s) of the present disclosure is/are operatively linked to expression control sequences allowing expression in prokaryotic and/or eukaryotic host cells. As used herein, "operatively linked" means incorporated into a genetic construct so that expression control sequences effectively control expression of a coding sequence of interest. The transcriptional/translational regulatory elements referred to above include but are not limited to inducible and non-inducible, constitutive, cell cycle regulated, metabolically regulated promoters, enhancers, operators, silencers, repressors and other elements that are known to those skilled in the art and that drive or otherwise regulate gene expression. Such regulatory elements include but are not limited to regulatory elements directing constitutive expression or which allow inducible expression like, for example, CUP-1 promoter, the tetrepressor as employed, for example, in the tet-on or tet-off systems, the lac system, the trp system regulatory elements. By way of example, Isopropyl β-D-1-thiogalactopyranoside (IPTG) is an effective inducer of gene expression in the concentration range of 100 µM to 1.0 mM. This compound is a molecular mimic of allolactose, a lactose metabolite that triggers transcription of the lac operon, and it is therefore used to induce gene expression when the gene is under the control of the lac operator. Another example of a regulatory element which induces gene expression is lactose.

Similarly, the nucleic acid molecule(s) of the present disclosure can form part of a hybrid gene encoding additional polypeptide sequences, for example, a sequence that functions as a marker or reporter. Examples of marker and reporter genes including beta-lactamase, chloramphenicol acetyltransferase (CAT), adenosine deaminase (ADA), aminoglycoside phosphotransferase dihydrofolate reductase (DHFR), hygro-mycin-B-phosphotransferase (HPH), thymidine kinase (TK), lacZ (encoding betagalactosidase), and xanthine guanine phosphoribosyltransferase (XGPRT). As with many of the standard procedures associated with the practice of the disclosure, skilled artisans will be aware of additional useful reagents, for example, additional sequences that can serve the function of a marker or reporter.

In some embodiment, the present disclosure provides a recombinant polynucleotide encoding the WT SHC or the SHC/HAC derivative described above, which may be inserted into a vector for expression and optional purification. One type of vector is a plasmid representing a circular double stranded DNA loop into which additional DNA segments are ligated. Certain vectors can control the expression of genes to which they are functionally linked. These vectors are called "expression vectors". Usually expression vectors suitable for DNA recombination techniques are of the plasmid type. Typically, an expression vector comprises a gene such as the WT SHC or the SHC/HAC variant as described herein. In the present description, the terms "plasmid" and "vector" are used interchangeably since the plasmid is the vector type most often used.

Such vectors can include DNA sequences which include but are not limited to DNA sequences that are not naturally present in the host cell, DNA sequences that are not normally transcribed into RNA or translated into a protein ("expressed") and other genes or DNA sequences which one desires to introduce into the non-recombinant host. It will be appreciated that typically the genome of a recombinant host described herein is augmented through the stable introduction of one or more recombinant genes. However, autonomous or replicative plasmids or vectors can also be used within the scope of this disclosure. Moreover, the present disclosure can be practiced using a low copy number, eg., a single copy, or high copy number (as exemplified herein) plasmid or vector.

In a preferred embodiment the vector of the present disclosure comprises plasmids, phagemids, phages, cosmids, artificial bacterial and artificial yeast chromosomes, knock-out or knock-in constructs, synthetic nucleic acid sequences or cassettes and subsets may be produced in the form of linear polynucleotides, plasmids, megaplasmids, synthetic or artificial chromosomes, such as plant, bacterial, mammalian or yeast artificial chromosomes.

It is preferred that the proteins encoded by the introduced polynucleotide are expressed within the cell upon introduction of the vector. The diverse gene substrates may be incorporated into plasmids. The plasmids are often standard cloning vectors, eg., bacterial multicopy plasmids. The substrates can be incorporated into the same or different plasmids. Often at least two different types of plasmid having different types of selectable markers are used to allow selection for cells containing at least two types of vectors.

Typically bacterial or yeast cells may be transformed with any one or more of the following nucleotide sequences as is well known in the art. For in vivo recombination, the gene to be recombined with the genome or other genes is used to transform the host using standard transforming techniques. In a suitable embodiment DNA providing an origin of replication is included in the construct. The origin of replication may be suitably selected by the skilled person. Depending on the nature of the genes, a supplemental origin of replication may not be required if sequences are already present with the genes or genome that are operable as origins of replication themselves.

A bacterial or yeast cell may be transformed by exogenous or heterologous DNA when such DNA has been introduced inside the cell. The transforming DNA may or may not be integrated, i.e. covalently linked into the genome of the cell. In prokaryotes, and yeast, for example, the transforming DNA may be maintained on an episomal element such as a plasmid. With respect to eukaryotic cells, a stably transfected cell is one in which the transfected DNA has become integrated into a chromosome so that it is inherited by daughter cells through chromosome replication. This stability is demonstrated by the ability of the eukaryotic cell to establish cell lines or clones comprised of a population of daughter cells containing the transforming DNA.

Generally, the introduced DNA is not originally resident in the host that is the recipient of the DNA, but it is within the scope of the disclosure to isolate a DNA segment from a given host, and to subsequently introduce one or more additional copies of that DNA into the same host, eg., to enhance production of the product of a gene or alter the expression pattern of a gene. In some instances, the introduced DNA will modify or even replace an endogenous gene or DNA sequence by, eg., homologous recombination or site-directed mutagenesis. Suitable recombinant hosts include microorganisms, plant cells, and plants.

The present disclosure also features recombinant hosts. The term "recombinant host", also referred to as a "genetically modified host cell" or a "transgenic cell" denotes a host cell that comprises a heterologous nucleic acid or the genome of which has been augmented by at least one incorporated DNA sequence. A host cell of the present disclosure may be genetically engineered with the polynucleotide or the vector as outlined above.

The host cells that may be used for purposes of the disclosure include but are not limited to prokaryotic cells such as bacteria (for example, *E. coli* and *B. subtilis*), which can be transformed with, for example, recombinant bacteriophage DNA, plasmid DNA, bacterial artificial chromosome, or cosmid DNA expression vectors containing the polynucleotide molecules of the disclosure; simple eukaryotic cells like yeast (for example, *Saccharomyces* and *Pichia*), which can be transformed with, for example, recombinant yeast expression vectors containing the polynucleotide molecule of the disclosure. Depending on the host cell and the respective vector used to introduce the polynucleotide of the disclosure the polynucleotide can integrate, for example, into the chromosome or the mitochondrial DNA or can be maintained extrachromosomally like, for example, episomally or can be only transiently comprised in the cells.

The term "cell" as used herein in particular with reference to genetic engineering and introducing one or more genes or an assembled cluster of genes into a cell, or a production cell is understood to refer to any prokaryotic or eukaryotic cell. Prokaryotic and eukaryotic host cells are both contemplated for use according to the disclosure, including bacterial host cells like *E. coli* or *Bacillus* sp, yeast host cells, such as *S. cerevisiae,* insect host cells, such as *Spodoptora frugiperda* or human host cells, such as HeLa and Jurkat.

Specifically, the cell is a eukaryotic cell, preferably a fungal, mammalian or plant cell, or prokaryotic cell. Suitable eukaryotic cells include, for example, without limitation, mammalian cells, yeast cells, or insect cells (including Sf9), amphibian cells (including melanophore cells), or worm cells including cells of *Caenorhabditis* (including *Caenorhabditis elegans*). Suitable mammalian cells include, for example, without limitation, COS cells (including Cos-1 and Cos-7), CHO cells, HEK293 cells, HEK293T cells, HEK293 T-RexTM cells, or other transfectable eukaryotic cell lines. Suitable bacterial cells include without limitation *E. coli*.

Preferably prokaryotes, such as *E. coli, Bacillus, Streptomyces,* or mammalian cells, like HeLa cells or Jurkat cells, or plant cells, like *Arabidopsis,* may be used.

Preferably the cell is an *Aspergillus* sp. or a fungal cell, preferably, it can be selected from the group consisting of the genera *Saccharomyces, Candida, Kluyveromyces, Hansenula, Schizosaccharomyces, Yarrowia, Pichia* and *Aspergillus*.

Preferably the *E. coli* host cell is an *E. coli* host cell which is recognized by the industry and regulatory authorities (including but not limited to an *E. coli* K12 host cell or as demonstrated in the Examples, an *E. coli* BL21 host cell).

One preferred host cell to use with the present disclosure is *E. coli,* which may be recombinantly prepared as described herein. Thus, the recombinant host may be a recombinant *E. coli* host cell. There are libraries of mutants, plasmids, detailed computer models of metabolism and other information available for *E. coli,* allowing for rational design of various modules to enhance product yield. Methods similar to those described above for *Saccharomyces* can be used to make recombinant *E. coli* microorganisms.

In one embodiment, the recombinant *E. coli* microorganism comprises nucleotide sequences encoding SHC genes (as disclosed for example in any one or more of Tables 10, 11 and 12 herein or functional equivalents/homologies thereof including but not limited to variants, homologues mutants, derivatives or fragments thereof.

Preferably, the recombinant *E. coli* microorganism comprises a vector construct as provided in FIGS. 5 and 21.

In another preferred embodiment, the recombinant *E. coli* microorganism comprises nucleotide sequences encoding WT SHC/HAC and WT SHC/HAC derivatives genes or functional equivalents/homologies thereof including but not limited to variants, homologues mutants, derivatives or fragments thereof as set out in any one or more of Table 13, Table 14, Table 15, Table 16, Table 17 and/or Table 4a.

Another preferred host cell to use with the present disclosure is *S. cerevisiae* which is a widely used chassis organism in synthetic biology. Thus, the recombinant host may be *S. cerevisiae.* There are libraries of mutants, plasmids, detailed computer models of metabolism and other information available for *S. cerevisiae,* allowing for rational design of various modules to enhance product yield. Methods are known for making recombinant *S. cerevisiae* microorganisms.

Culturing of cells is performed in a conventional manner. The culture medium contains a carbon source, at least one nitrogen source and inorganic salts, and vitamins are added to it. The constituents of this medium can be the ones which are conventionally used for culturing the species of microorganism in question.

Carbon sources of use in the instant method include any molecule that can be metabolized by the recombinant host cell to facilitate growth and/or production of (−)-Ambrox. Examples of suitable carbon sources include, but are not limited to, sucrose (eg., as found in molasses), fructose, xylose, glycerol, glucose, cellulose, starch, cellobiose or other glucose containing polymer.

In embodiments employing yeast as a host, for example, carbon sources such as sucrose, fructose, xylose, ethanol, glycerol, and glucose are suitable. The carbon source can be provided to the host organism throughout the cultivation period or alternatively, the organism can be grown for a period of time in the presence of another energy source, eg., protein, and then provided with a source of carbon only during the fed-batch phase.

The suitability of a recombinant host cell microorganism for use in the methods of the present disclosure may be determined by simple test procedures using well known methods. For example, the microorganism to be tested may be propagated in a rich medium (eg., LB-medium, Bactotryptone yeast extract medium, nutrient medium and the like) at a pH, temperature and under aeration conditions commonly used for propagation of the microorganism. Once recombinant microorganisms (i.e. recombinant host cells) are selected that produce the desired products of bioconversion, the products are typically produced by a production host cell line on the large scale by suitable expression systems and fermentations, eg. by microbial production in cell culture.

In one embodiment of the present disclosure, a defined minimal medium such as M9A is used for cell cultivation. The components of M9A medium comprise: 14 g/l $KH_2PO_4$, 16 g/l $K_2HPO_4$, 1 g/l $Na_3Citrate.2H_2O$, 7.5 g/l $(NH_4)_2SO_4$, 0.25 g/l $MgSO_4.7H_2O$, 0.015 g/l $CaCl_2.2H_2O$, 5 g/l glucose and 1.25 g/l yeast extract).

In another embodiment of the present disclosure, nutrient rich medium such as LB was used. The components of LB medium comprise: 10 g/l tryptone, 5 g/l yeast ex-tract, 5 g/l NaCl.

Other examples of Mineral Medium and M9 Mineral Medium are disclosed, for example, in U.S. Pat. No. 6,524, 831B2 and US 2003/0092143A1.

The recombinant microorganism may be grown in a batch, fed batch or continuous process or combinations thereof. Typically, the recombinant microorganism is grown in a fermentor at a defined temperature(s) in the presence of a suitable nutrient source, eg., a carbon source, for a desired period of time to produce sufficient enzyme to bioconvert homofarnesol to Ambrox and to produce a desired amount of Ambrox including (−)-Ambrox.

The recombinant host cells may be cultivated in any suitable manner, for example by batch cultivation or fed-batch cultivation.

As used herein, the term "batch cultivation" is a cultivation method in which culture medium is neither added nor withdrawn during the cultivation.

As used herein, the term "fed-batch" means a cultivation method in which culture medium is added during the cultivation but no culture medium is withdrawn.

One embodiment of the present disclosure provides a method of producing Ambrox in a cellular system comprising expressing WT SHC or SHC/HAC derivatives under suitable conditions in a cellular system, feeding homofarnesol to the cellular system, converting homofarnesol to Ambrox using the SHC or SHC/HAC derivatives produced using the cellular system, collecting Ambrox from cellular system and optionally isolating the (−)-Ambrox materials from the system. Expression of other nucleotide sequences may serve to enhance the method. The bioconversion method can include the additional expression of other nucleotide sequences in the cellular system. The expression of other nucleotide sequences may enhance the bioconversion pathway for making (−)-Ambrox.

A further embodiment of the present disclosure is a bioconversion method of making (−)-Ambrox comprising growing host cells comprising WT SHC/HAC or SHC/HAC derivative genes, producing WT SHC/HAC or SHC/HAC derivatives in the host cells, feeding homofarnesol (eg. EEH) to the host cells, incubating the host cells under conditions of pH, temperature and solubilizing agent suitable to promote the conversion of homofarnesol to Ambrox and collecting (−)-Ambrox. The production of the WT SHC/HAC and/or SHC/HAC derivatives in the host cells provides a method of making (−)-Ambrox when homofarnesol is added to the host cells under suitable reaction conditions. Achieved conversion may be enhanced by adding more biocatalyst and SDS to the reaction mixture.

The recombinant host cell microorganism may be cultured in a number of ways in order to provide cells in suitable amounts expressing the WT SHC or SHC/HAC derivatives for the subsequent bioconversion step. Since the microorganisms applicable for the bioconversion step vary broadly (eg. yeasts, bacteria and fungi), culturing conditions are, of course, adjusted to the specific requirements of each species and these conditions are well known and documented. Any of the art known methods for growing cells of recombinant host cell microorganisms may be used to produce the cells utilizable in the subsequent bioconversion step of the present disclosure. Typically the cells are grown to a particular density (measurable as optical density (OD)) to produce a sufficient biomass for the bioconversion reaction.

The cultivation conditions chosen influence not only the amount of cells obtained (the biomass) but the quality of the cultivation conditions also influences how the biomass becomes a biocatalyst. The recombinant host cell microorganism expressing the WT SHC or SHC/HAC derivative gene and producing the WT SHC or SHC/HAC derivative enzymes is termed a biocatalyst which is suitable for use in a bioconversion reaction. In some embodiments the biocatalyst is a recombinant whole cell producing WT SHC or a SHC/HAC derivatives or it may be in suspension or an immobilized format. In other embodiments, the biocatalyst is a membrane fraction or a liquid fraction prepared from the recombinant whole cell producing the WT SHC or the SHC/HAC derivative (as disclosed for example in Seitz et al 2012—as cited above).

The recombinant whole cell producing WT SHC or a SHC/HAC derivatives include whole cells collected from the fermenter (for the bioconversion reaction) or the cells in the fermenter (which are then used in a one-pot reaction). The recombinant whole cell producing WT SHC or SHC/HAC derivatives can include intact recombinant whole cell and/or cell debris. Either way, the WT SHC or SHC/HAC derivative is associated with a membrane (such as a cell membrane) in some way in order to receive and/or interact with a substrate (eg. homofarnesol), which membrane (such as a cell membrane) can be part of or comprise a whole cell (eg. a recombinant whole cell). The WT SHC or SHC/HAC derivatives may also be in an immobilized form (eg. associated with an enzyme carrier) which allows the WT SHC or SHC/HAC derivatives to interact with a substrate (eg. homofarnesol). The WT SHC or SHC/HAC derivatives may also be used in a soluble form.

In one embodiment, the biocatalyst is produced in sufficient amounts (to create a sufficient biomass), harvested and washed (and optionally stored (eg. frozen or lyophilized)) before the bioconversion step.

In a further embodiment, the cells are produced in sufficient amounts (to create a sufficient biocatalyst) and the reaction conditions are then adjusted without the need to harvest and wash the biocatalyst for the bioconversion reaction. This one step (or "one pot") method is advantageous as it simplifies the process while reducing costs. The culture medium used to grow the cells is also suitable for use in the bioconversion reaction provided that the reaction conditions are adjusted to facilitate the bioconversion reaction.

The optimum pH for growing the cells is in the range of 6.0-7.0. The optimum pH for the bioconversion reaction is dependent on the type of SHC/HAC enzyme used in the bioconversion reaction. The pH is regulated using techniques which are well known to the Skilled Person.

As Example 9 demonstrates, a "one pot" method was used to bioconvert homofarnesol to (−)-Ambrox with a 100% conversion rate. As Example 18 demonstrates, a "one pot" method was used to bioconvert homofarnesol to (−)-Ambrox with a 99% conversion rate.

As used herein, any reference herein to a 99%/100% conversion rate for a homofarnesol substrate to (−)-Ambrox is a reference to a 99%/100% conversion of the homofarnesol isomer (i.e. EEH) capable of conversion to (−)-Ambrox using a WT SHC/HAC or a SHC/HAC derivative enzyme.

Whilst the terms "mixture" or "reaction mixture" may be used interchangeably with the term "medium" in the present disclosure (especially as it relates to a "one pot" reaction), it should be noted that growing the cells to create a sufficient biomass requires a cell culture/fermentation medium but a medium is not required for the bioconversion step as a reaction buffer will suffice at a suitable pH.

The bioconversion methods of the present disclosure are carried out under conditions of time, temperature, pH and solubilizing agent to provide for conversion of the homofarnesol feedstock to (−)-Ambrox. The pH of the reaction mixture may be in the range of 4-8, preferably, 5 to 6.5, more preferably 4.8-6.0 for the SHC/HAC derivative enzymes and in the range of from about pH 5.0 to about pH 7.0 for the WT SHC enzyme and can be maintained by the addition of buffers to the reaction mixture. An exemplary buffer for this purpose is a citric acid buffer. The preferred temperature is between from about 15° C. and about 45° C., preferably about 20° C. and about 40° C. although it can be higher, up to 55° C. for thermophilic organisms especially if the WT enzyme (eg. WT SHC/HAC) from the thermophilic microorganism is used. The temperature can be kept constant or can be altered during the bioconversion process.

The Applicant has demonstrated that it may be useful to include a solubilizing agent (eg. a surfactant, detergent, solubility enhancer, water miscible organic solvent and the like) in the bioconversion reaction. As used herein, the term "surfactant" means a component that lowers the surface tension (or interfacial tension) between two liquids or between a liquid and a solid. Surfactants may act as detergents, wetting agents, emulsifiers, foaming agents, and dispersants. Examples of surfactants include but are not limited to Triton X-100, Tween 80, taurodeoxycholate, Sodium taurodeoxycholate, Sodium dodecyl sulfate (SDS), and/or sodium lauryl sulfate (SLS).

Whilst Triton X-100 may be used to partially purify the WT SHC/HAC or SHC/HAC derivative enzyme (in soluble or membrane fraction/suspension form), it may also be used in the bioconversion reaction (see for example the disclosure in Seitz (2012 PhD thesis as cited above) as well as the disclosure in Neumann and Simon (1986—as cited above) and JP2009060799.

However, surprisingly, as Example 14 demonstrates, the Applicant selected and identified SDS as a particularly useful solubilizing agent from a long list of other less useful solubilizing agents. In particular, the Applicant identified SDS as a remarkably better solubilizing agent than eg. Triton X-100 in terms of reaction velocity and yield for the homofarnesol to (−)-Ambrox bioconversion reaction (when EEH is used at both 4 g/l and 125 g/l). As demonstrated by the comparative data in Example 12, the Applicant has demonstrated that for at least one SHC/HAC derivative enzyme, that maximal homofarnesol to (−)-Ambrox bioconversion activity with Triton X-100 (at a concentration range of about 0.005% to 0.48%) in the reaction was only around 20% of the activity obtained with SDS (at a concentration of about 0.07%).

Without wishing to be bound by theory, the use of SDS with recombinant microbial host cells may be advantageous as the SDS may interact advantageously with the host cell membrane in order to make the SHC enzyme (which is a membrane bound enzyme) more accessible to the homofarnesol substrate. In addition, the inclusion of SDS at a suitable level in the reaction mixture may improve the properties of the emulsion (homofarnesol in water) and/or improve the access of the homofarnesol substrate to the SHC enzyme within the host cell while at the same time preventing the disruption (eg. denaturation of the SHC (WT or SHC/HAC derivative) enzyme).

The concentration of the solubilising agent (eg. SDS) used in the bioconversion reaction is influenced by the biomass amount and the substrate (EEH) concentration. That is, there is a degree of interdependency between the solubilising agent (eg. SDS) concentration, the biomass amount and the substrate (EEH) concentration. By way of example, as the concentration of homofarnesol substrate increases, sufficient amounts of biocatalyst and solubilising agent (eg. SDS) are required for an efficient bioconversion reaction to take place. If, for example, the solubilising agent (eg. SDS) concentration is too low, a suboptimal homofarnesol conversion may be observed. On the other hand, if, for example, the solubilising agent (eg. SDS) concentration is too high, then there may be a risk that the biocatalyst is affected through either the disruption of the intact microbial cell and/or denaturation/inactivation of the SHC/HAC enzyme.

The selection of a suitable concentration of SDS in the context of the biomass amount and, substrate (EEH) concentration is within the knowledge of the Skilled Person. By way of example, a predictive model is available to the Skilled Person to determine the suitable SDS, substrate (EEH) and biomass concentrations. By way of further example, Example 3 demonstrates that SDS in the range of 0.010-0.075% is appropriate when 4 g/l EEH and biocatalyst to an OD of 10.0 (650 nm) are used. Example 7 demonstrates that when 125 g/l EEH is used with 2× the wet weight of biomass, an adjusted SDS concentration (1.55%) is appropriate. However, an investigation of the percent EEH conversion to (−)-Ambrox using different SDS/cells ratio values indicated that the correct selection of the ratio of biocatalyst, homofarnesol substrate and solubilising agent (eg. SDS) facilitates the development of a robust bioconversion reaction system which demonstrates a degree of tolerance to a range of SDS concentrations (see for example FIG. 17) and pH ranges (see Example 15, FIG. 18).

The temperature of the bioconversion reaction for a WT SHC enzyme (eg. AacSHC) is from about 45-60° C., preferably 55° C.

The pH range of the bioconversion reaction for a WT SHC enzyme (eg. AacSHC) is from about 5.0 to 7.0, more preferably from about 5.6 to about 6.2, even more preferably about 6.0.

The temperature of the bioconversion reaction for a SHC/HAC derivative enzyme is about 34° C. to about 50° C., preferably about 35° C.

The pH of the bioconversion reaction for a SHC/HAC derivative enzyme is about 4.8-6.4, preferably about 5.2-6.0.

Preferably the solubilising agent used in the bioconversion reaction is SDS.

The SDS concentration used in the bioconversion reaction for the WT SHC enzyme (eg. AacSHC) is in the range of about 0.010-0.075%, preferably about 0.030% when EEH at about 4 g/l is used.

The SDS concentration used in the bioconversion reaction for the SHC/HAC derivative enzyme is in the range of about 0.0025-0.090%, preferably about 0.050% when EEH at about 4 g/l is used.

The biocatalyst is loaded to the reaction to an OD of 10.0 (650 nm) when the reaction is loaded with homofarnesol at an EEH concentration of about 4 g/l EEH.

The [SDS]/[cells] ratio is in the range of about, 10:1-20:1, preferably about 15:1-18:1, preferably about 16:1 when the ratio of biocatalyst to EEH homofarnesol is about 2:1

The SDS concentration in the bioconversion reaction for a SHC variant enzyme is in the range of about 1-2%, preferably in the range of about 1.4-1.7%, even more preferably about 1.5% when the homofarnesol concentration is about 125 g/l EEH and the biocatalyst concentration is 250 g/l (corresponding to an OD of about 175 (650 nm)).

The ratio of biocatalyst to EEH homofarnesol substrate is in the range of about 0.5:1-2:1, in some embodiments 2:1, preferably about 1:1 or 0.5:1.

In some embodiments, Ambrox is produced using a biocatalyst to which the homofarnesol substrate is added. It is possible to add the substrate by feeding using known means (eg. peristaltic pump, infusion syringe and the like). Homofarnesol is an oil soluble compound and is provided in an oil format. Given that the biocatalyst (microbial cells such as intact recombinant whole cell and/or cell debris and/or immobilised enzyme) is present in an aqueous phase, the bioconversion reaction may be regarded as a three phase system (comprising an aqueous phase, a solid phase and an oil phase) when homofarnesol is added to the bioconversion reaction mixture. This is the case even when SDS is present. By way of clarification, when a soluble WT SHC or a SHC/HAC derivative is used as a biocatalyst, this is considered a two phase system.

The number of homofarnesol isomers present may influence the speed of the reaction. As Example 11 demonstrates, an SHC/HAC derivative enzyme is capable of bioconverting E,E-homofarnesol to (−)-Ambrox from a complex mixture of homofarnesol isomers (eg. EE:EZ:ZE:ZZ). However, a lower conversion rate is typically observed which is consistent with the view that homofarnesol isomers other than EEH may compete with EEH for access to the SHC/HAC derivative enzymes and thus may act as competitive inhibitors for the conversion of EEH to (−)-Ambrox and/or also act as alternative substrates.

Accordingly, preferably the homofarnesol substrate comprises a stereoisomeric mixture of 2-4 isomers, preferably two isomers.

Accordingly, preferably the homofarnesol substrate consists of or consists essentially of a stereoisomeric mixture of 2-4 isomers, preferably two isomers. Preferably the homofarnesol substrate comprises an EE:EZ stereoisomeric mixture.

Preferably the homofarnesol substrate consists of or consists essentially of an EE:EZ stereoisomeric mixture.

As Example 9 demonstrates, a 100% conversion of EE:EZ in a weight ratio of 87:13 was observed in a "one pot" fermentation and bioconversion reaction carried out over a period of 22.5 days. About 10 g of EEH was converted over this period of time.

As described in detail in Example 7, in a preferred embodiment, a fermenter is used to grow recombinant host cell expressing the SHC/HAC derivative gene and producing active SHC/HAC derivative enzymes to a sufficient biomass concentration suitable for use as a biocatalyst in the same fermenter vessel which is used to convert the homofarnesol source to (−)-Ambrox in admixture with one or more of the by-products (II), (IV) and/or (III as disclosed, for example, in FIG. 12). The resulting (−)-Ambrox may be isolated by steam extraction/distillation or organic solvent extraction using a non-water miscible solvent (to separate the reaction products and unreacted substrate from the biocatalyst which stays in the aqueous phase) followed by subsequent evaporation of the solvent to obtain a crude reaction product as determined by gas chromatographic (GC) analysis. The steam extraction/distillation and organic solvent extraction methods are known to those skilled in the art.

By way of example, the resulting (−)-Ambrox may be extracted from the whole reaction mixture using an organic solvent such as a non-water miscible solvent (for example toluene). Alternatively, the resulting (−)-Ambrox may be extracted from the solid phase of the reaction mixture (obtained by, for example, centrifugation or filtration) using a water miscible solvent (for example ethanol) or a non-water miscible solvent (for example toluene). By way of further example, (−)-Ambrox is present in the solid phase as crystals or in amorphous form and can be separated from the remaining solid phase (cell material or debris thereof) and the liquid phase also by means of filtration. By way of further example, at a temperature above the melting point of (−)-Ambrox (around. 75° C.), the (−)-Ambrox may form an oil layer on top of aqueous phase, which oil layer can be removed and collected. In order to ensure a complete recovery of (−)-Ambrox after the oil layer is removed, an organic solvent may be added to the aqueous phase containing the biomass in order to extract any residual (−)-Ambrox contained in, or on or about the biomass. The organic layer can be combined with the oil layer, before the whole is further processed to isolate and purify (−)-Ambrox.

The (−)-Ambrox may be further selectively crystallised to remove by-products (II), (IV) and (III) and any unreacted homofarnesol substrate from the final (−)-Ambrox product. The term "selective crystallization" refers to a process step whereby (−)-Ambrox is caused to crystallise from a solvent whilst the compounds (II), (III) and (IV) remain dissolved in the crystallising solvent to such an extent that isolated crystalline material contains only (−)-Ambrox product, or if it contains any of the other compounds (II), (III) or (IV), then they are present only in olfactory acceptable amounts.

The selective crystallisation step may use a water miscible solvent such as ethanol or the like. The olfactive purity of the final (−)-Ambrox product is determined using a 10% ethanol extract in water or by testing the crystalline material. The final (−)-Ambrox product is tested against a commercially available reference of (−)-Ambrox product for its olfactive purity, quality and its sensory profile. The (−)-Ambrox material is also tested in application studies by experts in order to determine if the material meets the specifications with respect to its organoleptic profile. Various applications for (−)-Ambrox include but are not limited to a fine fragrance or a consumer product such as fabric care, toiletries, beauty care and cleaning products including essentially all products where the currently available Ambrox ingredients are used commercially, including but not limited to: Ambrox (Firmenich), Ambroxan (Henkel), Ambrofix (Givaudan), Amberlyn (Quest), Cetalox Laevo (Firmenich), Ambermor (Aromor) and Norambrenolide Ether (Pacific) products.

The selective crystallisation of (−)-Ambrox may be influenced by the presence of unreacted homofarnesol substrate and also the ratio of (−)-Ambrox to the other detectable by-products (II), (III) and/or (IV). Even if only 10% conversion of the homofarnesol substrate to (−)-Ambrox is obtained (as demonstrated in Example 7 using a WT SHC/HAC enzyme), the selective crystallisation of (−)-Ambrox is still possible.

Examples of suitable water miscible and non-water miscible organic solvents suitable for use in the extraction and/or selective crystallization of (−)-Ambrox include but are not limited to aliphatic hydrocarbons, preferably those having 5 to 8 carbon atoms, such as pentane, cyclopentane, hexane, cyclohexane, heptane, octane or cyclooctane, halogenated aliphatic hydrocarbons, preferably those having one or two carbon atoms, such as dichloromethane, chloroform, carbon tetrachloride, dichloroethane or tetrachloroethane, aromatic hydrocarbons, such as benzene, toluene, the xylenes, chlorobenzene or dichlorobenzene, aliphatic acyclic and cyclic ethers or alcohols, preferably those having 4 to 8 carbon atoms, such as ethanol, isopropanol, diethyl ether, methyl tert.-butyl ether, ethyl tert.-butyl ether, dipropyl ether, diisopropyl ether, dibutyl ether, tetrahydrofuran or esters such as ethyl acetate or n-butyl acetate or ketones such as methyl isobutyl ketone or dioxane or mixtures of these. The solvents which are especially preferably used are the abovementioned heptane, Methyl tert-butyl ether (also known as MTBE, tert-butyl methyl ether, tertiary butyl methyl ether and tBME), diisopropyl ether, tetrahydrofuran, ethyl acetate and/or mixtures thereof.

Preferably, a water miscible solvent such as ethanol is used for the extraction of (−)-Ambrox from the solid phase of the reaction mixture. The use of ethanol is advantagous because it is easy to handle, it is non toxic and it is environmentally friendly.

The term "isolated" as used herein refers to a bioconversion product such as (−)-Ambrox which has been separated or purified from components which accompany it. An entity that is produced in a cellular system different from the source from which it naturally originates is "isolated", because it will necessarily be free of components which naturally accompany it. The degree of isolation or purity can be measured by any appropriate method, eg., gas chromatography (GC), HPLC or NMR analysis.

In some embodiments, the end product ((−)-Ambrox) is isolated and purified to homogeneity (eg., at least 80%, 81%, 82%, 83%, 84%, 85%, 86%, 87%, 88%, 89%, or 89.5% pure or 90%, 91%, 92%, 93%, 94%, 95%, 96%, 97%, 98%, 99%, or 99.5% pure).

Desirably, the amount of (−)-Ambrox produced can be from about 1 mg/l to about 20,000 mg/l (20 g/l) or higher such as from about 20 g/l to about 200 g/l or from 100-200 g/l, preferably about 125 g/l or 150 g/l or about 188 g/l.

As Example 7 demonstrates, at least 125 g/l (−)-Ambrox is produced in a bioconversion reaction using a recombinant E. coli host cell producing a SHC/HAC derivative enzyme over about 2 days.

As Example 19 demonstrates, it is possible to run bioconversions at 188 g/l EEH or higher provided efficient mixing is achieved as stirring efficiency appears to be the only limitation of the system. In addition, a biocatalyst with improved activity (eg. in terms of SHC variants with further improved activity or in terms of increased SHC enzyme production) may improve or maintain productivity using less biomass which is advantageous with respect to mixing efficiencies.

For example about 1 to about 100 mg/l, about 30 to about 100 mg/l, about 50 to about 200 mg/l, about 100 to about 500 mg/l, about 100 to about 1,000 mg/l, about 250 to about 5,000 mg/l, about 1,000 (1 g/l) to about 15,000 mg/l (15 g/l), or about 2,000 (2 g/l) to about 10,000 mg/l (10 g/l) or about 2,000 (2 g/l) to about 25,000 mg/l (25 g/l) or about 2,000 (2 g/l) to about 25,000 mg/l (25 g/l), 26,000 mg/l (26 g/l), 27,000 mg/l (27 g/l), 28,000 mg/l (28 g/l), 29,000 mg/l (29 g/l), 30,000 mg/l (30 g/l), 40 g/l, 50 g/l 60 g/l, 70 g/l, 80 g/l, 90 g/l, 100 g/l, 110 g/l, 120 g/l, 125 g/l, 130 g/l, 140 g/l, 150 g/l, 160 g/l, 170 g/l, 180 g/l, 190 g/l or 200 g/l or 300 g/l or 400 g/l or 500 g/l of (−)-Ambrox is produced.

Preferably (−)-Ambrox at a concentration of at least 100 g/l is produced within a period of time of from 48 to 72 hours.

Preferably (−)-Ambrox at a concentration of about 150 g/l is produced within a time period of from about 48 to 72 hours.

Preferably (−)-Ambrox at a concentration of about 200 g/l is produced within a time period of from about 48 to 72 hours.

Preferably (−)-Ambrox at a concentration of about 250 g/l is produced within a time period of from about 48 to 72 hours.

The Skilled Person will understand that higher cumulative production titers can be achieved by implementing a continuous process, such as product removal, substrate feed, and biomass addition or (partial) replacement.

Preferably the bioconversion of EEH into (−)-Ambrox in the presence of a recombinant host cell comprising a WT SHC/HAC or a SHC/HAC derivative generates an Ambrox yield of 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, given in mol percent and based on the mols of EEH employed; especially preferably, the yield is between 5 and 100, 10 and 100, and 100, 25 and 100, 30 and 100, 35 and 100, in particular between 40 and 100, 45 and 100, 50 and 100, 60 and 100, 70 and 100 mol percent.

The activity of the SHC/HAC enzyme is defined via the reaction rate (amount of product/(amount of product+ amount of remaining starting material))×100) in mol percent. Preferably, the bioconversion of EEH into (−)-Ambrox in the presence of WT SHC or a SHC/HAC derivative enzyme produces an (−)-Ambrox yield of 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, given in mol percent and based on the mols of EEH employed; especially preferably, the yield is between 5 and 100, 10 and 100, 20 and 100, 25 and 100, 30 and 100, 35 and 100, in particular between 40 and 100, 45 and 100, 50 and 100, 60 and 100, 70 and 100.

In a preferred embodiment of the invention, the yield and/or the reaction rate are determined over a defined time period of, for example, 4, 6, 8, 10, 12, 16, 20, 24, 36 or 48 hours, during which EEH is converted into (−)-Ambrox by a recombinant host cell comprising a nucleotide sequence encoding a WTSHC or the SHC/HAC derivative enzyme according to the present disclosure. In a further variant, the reaction is carried out under precisely defined conditions of, for example, 25° C., 30° C., 40° C., 50° C. or 60° C. In particular, the yield and/or the reaction rate are determined by carrying out the reaction of converting EEH into (−)-Ambrox by the SHC/HAC derivative enzymes according to the invention at 35° C. over a period of 24-72 hours.

In a further embodiment of the present invention, a recombinant host cell comprising a nucleotide sequence encoding a SHC/HAC derivative is characterized in that it shows a 2-, 3-, 4-, 5-, 6-, 7-, 8-, 9-, 10-, 11-, 12-, 13-, 14-, 15-, 16-, 17-, 18-, 19-, 20-, 21-, 22-, 23-, 24-, 25-, 26-, 27-, 28-, 29-, 30-, 31-, 32-, 33-, 34-, 35-, 36-, 37-, 38-, 39-, 40-, 41-, 42-, 43-, 44-, 45-, 46-, 47-, 48-, 49-, 50-, 51-, 52-, 53-, 54-, 55-, 56-, 57-, 58-, 59-, 60-, 61-, 62-, 63-, 64-, 65-, 66-, 67-, 68-, 69-, 70-, 71-, 72-, 73-, 74-, 75-, 76-, 77-, 78-, 79-, 80-, 81-, 82-, 83-, 84-, 85-, 86-, 87-, 88-, 89-, 90-, 91-, 92-, 93-, 94-, 95-, 96-, 97-, 98-, 99-, 100-, 200-, 500-, 1000-fold or higher yield and/or reaction rates in the reaction of homofarnesol to give (−)-Ambrox in comparison with the WT SHC or SHC/HAC derivative enzyme under the same conditions. Here, the term condition relates to reaction conditions such as substrate concentration, enzyme concentration, reaction period and/or temperature.

The successful development of a bioconversion process for making (−)-Ambrox from homofarnesol in a recombinant strain of E. coli comprising a nucleotide sequence encoding a WT/reference SHC or a SHC/HAC derivative can offer a low cost and industrially economical process for (−)-Ambrox production.

As Example 7 demonstrates, the present disclosure provides for a 100% conversion of E,E-Homofarnesol (125 g/l) to (−)-Ambrox after 48 hours of incubation with an optimised SHC/HAC Derivative with a 8-fold improvement in yield when an AacSHC derivative is used compared with the WT AacSHC enzyme (see FIG. 11).

Functional homologs of the WT Reference SHC/HAC or the SHC/HAC derivative polypeptides described herein are also suitable for use in producing Ambrox in a recombinant host. Thus, the recombinant host may include one or more heterologous nucleic acid(s) encoding functional homologs of the polypeptides described above and/or a heterologous nucleic acid encoding a SHC/HAC derivative enzyme as described herein.

A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild-type coding sequence, may themselves be functional homologs. Functional homologs can also be created via site-directed mutagenesis of the coding sequence for a polypeptide, or by combining domains from the coding sequences for different naturally-occurring polypeptides ("domain swapping"). Techniques for modifying genes encoding functional homologs described herein are known and include, inter alia, directed evolution techniques, site-directed mutagenesis techniques and random mutagenesis techniques, and can be useful to increase specific activity of a polypeptide, alter substrate specificity, alter expression levels, alter subcellular location, or modify polypeptide: polypeptide interactions in a desired manner. Such modified polypeptides are considered functional homologs. The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of the nucleic acid sequences encoding the SHC derivative polypeptides and the like.

Hybridization can also be used to identify functional homologs and/or as a measure of homology between two nucleic acid sequences. A nucleic acid sequence encoding any of the proteins disclosed herein, or a portion thereof, can be used as a hybridization probe according to standard hybridization techniques. The hybridization of a probe to DNA or RNA from a test source (eg., a mammalian cell) is an indication of the presence of the relevant DNA or RNA in the test source. Hybridization conditions are known to those skilled in the art and can be found in Current Protocols in Molecular Biology, John Wiley & Sons, N.Y., 6.3.1-6.3.6, 1991. Moderate hybridization conditions are defined as equivalent to hybridization in 2× sodium chloride/sodium citrate (SSC) at 30° C. followed by a wash in 1×SSC, 0.1% SDS at 50° C. Highly stringent conditions are defined as equivalent to hybridization in 6× sodium chloride/sodium citrate (SSC) at 45° C. followed by a wash in 0.2× SSC, 0.1% SDS at 65° C.

Sequence analysis to identify functional homologs can also involve BLAST, Reciprocal BLAST, or PSI-BLAST analysis of non-redundant databases using a relevant amino acid sequence as the reference sequence. Amino acid sequence is, in some instances, deduced from the nucleotide sequence. Those polypeptides in the database that have greater than 40% sequence identity are candidates for further evaluation for suitability for use in the SHC/HAC bioconversion reaction. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have for eg., conserved functional domains.

Typically, polypeptides that exhibit at least about 30% amino acid sequence identity are useful to identify conserved regions. Conserved regions of related polypeptides exhibit at least 30%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, amino acid sequence identity. In some embodiments, a conserved region exhibits at least, 70%, 71%, 72%, 73%, 74%, 75%, 76%, 77%, 78%, 79%, 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity. Sequence identity can be determined as set forth above and below.

The produced WTSHC and/or SHC/HAC Derivative is based on an amino acid SEQ ID No. 1 or SEQ ID No. 2 or SEQ ID No. 3 or SEQ ID No. 4 or a variant, homologue, mutant, derivative or fragment thereof.

The produced SHC is based on an amino acid sequence with at least 30%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%,70%, 71%, 72%, 73%, 74%, 75%, 76%, 77%, 78%, 79%, 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% identity to SEQ ID No. 1 or SEQ ID No. 2 or SEQ ID No. 3 or SEQ ID No. 4.

In addition, the produced reference SHC is based on an amino acid sequence produced from *E. coli*.

"Percent (%) identity" with respect to the nucleotide sequence of a gene is defined as the percentage of nucleotides in a candidate DNA sequence that is identical with the nucleotides in the DNA sequence, after aligning the sequence and introducing gaps, if necessary, to achieve the maximum percent sequence identity, and not considering any conservative substitutions as part of the sequence identity. Alignment for purposes of determining percent nucleotide sequence identity can be achieved in various ways that are within the skill in the art, for instance, using publicly available computer software. Those skilled in the art can determine appropriate parameters for measuring alignment, including any algorithms needed to achieve maximal alignment over the full length of the sequences being compared.

The terms "polypeptide" and "protein" are used interchangeably herein and mean any peptide-linked chain of amino acids, regardless of length or post-translational modification. As used herein the term "derivative" includes but is not limited to a variant. The terms "derivative" and "variant" are used interchangeably herein.

As used herein, the term "variant" is to be understood as a polypeptide which differs in comparison to the polypeptide from which it is derived by one or more changes in the amino acid sequence. The polypeptide from which a variant is derived is also known as the parent or reference polypeptide. Typically a variant is constructed artificially, preferably by gene-technological means. Typically, the polypeptide from which the variant is derived is a wild-type protein or wild-type protein domain. However, the variants usable in the present disclosure may also be derived from homologs, orthologs, or paralogs of the parent polypeptide or from artificially con-structed variants, provided that the variant exhibits at least one biological activity of the parent polypeptide. The changes in the amino acid sequence may be amino acid exchanges, insertions, deletions, N-terminal truncations, or C-terminal truncations, or any combination of these changes, which may occur at one or several sites.

In preferred embodiments, a variant usable in the present disclosure exhibits a total number of up to 200 (up to 1, 2, 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, or 200) changes in the amino acid sequence (i.e. exchanges, insertions, deletions, N-terminal truncations, and/or C-terminal truncations). The amino acid exchanges may be conservative and/or non-conservative. In preferred embodiments, a variant usable in the present disclosure differs from the protein or domain from which it is derived by up to 1, 2, 3, 4, 5, 6, 7, 8, 9, 10, 15, 20, 25, 30, 35, 40, 45, 50, 55, 60, 65, 70, 75, 80, 85, 90, 95, or 100 amino acid exchanges, preferably conservative amino acid changes. Variants may additionally or alternatively comprise deletions of amino acids, which may be N-terminal truncations, C-terminal truncations or internal deletions or any combination of these. Such variants comprising N-terminal truncations, C-terminal truncations and/or internal deletions are referred to as "deletion variants" or "fragments" in the context of the present application. The terms "deletion variant" and "fragment" are used interchangeably herein. A deletion variant may be naturally occurring (eg. splice variants) or it may be constructed artificially, preferably by gene-technological means. Typically, the protein or protein domain from which the deletion variant is derived is a wild-type protein. However, the deletion variants of the present disclosure may also be derived from homologs, orthologs, or paralogs of the parent polypeptide or from artificially constructed variants, provided that the deletion variants exhibit at least one biological activity of the parent polypeptide. Preferably, a deletion variant (or fragment) has a deletion of up to 1, 2, 3, 4, 5, 6, 7, 8, 9, 10, 15, 20, 25, 30, 35, 40, 45, 50, 55, 60, 65, 70, 75, 80, 85, 90, 95, or 100 amino acids at its N-terminus and/or at its C-terminus and/or internally as compared to the parent polypeptide.

A "variant" as used herein, can alternatively or additionally be characterised by a certain degree of sequence identity to the parent polypeptide from which it is derived. A variant of the WT/reference SHC/HAC or the SHC/HAC Derivative of the present disclosure may have a sequence identity of at least 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%,70%, 71%, 72%, 73%, 74%, 75%, 76%, 77%, 78%, 79%, 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% identity to the respective reference polypeptide or to the respective reference polynucleotide.

The expression "at least 30%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%,70%, 71%, 72%, 73%, 74%, 75%, 76%, 77%, 78%, 79%, 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity" is used throughout the specification with regard to polypeptide and polynucleotide sequence comparisons.

A polynucleotide belonging to a family of any of the enzymes disclosed herein or a protein can be identified based on its similarity to the relevant gene or protein, respectively. For example, the identification can be based on sequence identity. In certain preferred embodiments the disclosure features isolated nucleic acid molecules which are at least 30%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% identical to (a) a nucleic acid molecule that encodes the polypeptide of SEQ ID No. 5-163 (see Tables 14-17 and Table 4a as provided herein) (b) the nucleotide sequence of SEQ ID No. 6-168, 169, 170, 172, 174 and 176 (see Tables 14-17 and Table 4a as provided herein) and (c) a nucleic acid molecule which includes a segment of at least 30 (eg., at least 30, 40, 50, 60, 80, 100, 125, 150, 175, 200, 250, 300, 400, 500, 600, 700, 800, 850, 900, 950, 1000, or 1010) nucleotides of SEQ ID No. 6-168, 169, 170, 172, 174 and 176 (see Tables 14-17 and Table 4a as provided herein).

Preferably, the polypeptide in question and the reference polypeptide exhibit the indicated sequence identity over a continuous stretch of 20, 30, 40, 45, 50, 60, 70, 80, 90, 100 or more amino acids. Preferably, the polynucleotide in question and the reference polynucleotide exhibit the indicated sequence identity over a continuous stretch of 60, 90, 120, 135, 150, 180, 210, 240, 270, 300 or more nucleotides. In case where two sequences are compared and the reference sequence is not specified in comparison to which the sequence identity percentage is to be calculated, the sequence identity is to be calculated with reference to the longer of the two sequences to be compared, if not specifically indicated otherwise. If the reference sequence is indicated, the sequence identity is determined on the basis of the full length of the reference sequence indicated by SEQ ID No. 1, 2, 3 and/or 4 if not specifically indicated otherwise.

For example, a peptide sequence consisting of 130 amino acids compared to the amino acids of full length of reference SHC with 631 amino acid residues may exhibit a maximum sequence identity percentage of 20.6% (130/631×100) while a sequence with a length of 300 amino acids may exhibit a maximum sequence identity percentage of 47.5% (300/631×100). The similarity of nucleotide and amino acid sequences, i.e. the percentage of sequence identity, can be determined via sequence alignments. Such alignments can be carried out with several art-known algorithms, preferably with the mathematical algorithm of Karlin and Altschul (Karlin & Altschul (1993) Proc. Natl. Acad. Sci. USA 90: 5873-5877), with hmmalign (HMMER package or with the CLUSTAL algorithm (Thompson, J. D., Higgins, D. G. & Gibson, T. J. (1994) Nucleic Acids Res. 22, 4673-80) or the GAP program (mathematical algorithm of the University of Iowa) as utilised in the sequence alignments to WTSHC as provided in Table 18 herein or the mathematical algorithm of Myers and Miller (1989—Cabios 4: 11-17) as disclosed in and as utilised in the WTSHC sequence alignments in Table 19 as provided herein.

The grade of sequence identity (sequence matching) may be calculated using eg. BLAST, BLAT or BlastZ (or BlastX). A similar algorithm is incorporated into the BLASTN and BLASTP programs of Altschul et al (1990) J. Mol. Biol. 215, 403-410. BLAST polynucleotide searches are performed with the BLASTN program, score=100, word length=12, to obtain polynucleotide sequences that are homologous to those nucleic acids which encode the relevant protein.

BLAST protein searches are performed with the BLASTP program, score=50, word length=3, to obtain amino acid sequences homologous to the SrKO polypeptide. To obtain gapped alignments for comparative purposes, Gapped BLAST is utilized as described in Altschul et al (1997) Nucleic Acids Res. 25, 3389-3402. When utilizing BLAST and Gapped BLAST programs, the default parameters of the respective programs are used. Sequence matching analysis may be supplemented by established homology mapping techniques like Shuffle-LAGAN (Brudno M., Bioinformatics 2003b, 19 Suppl 1:154-162) or Markov random fields. When percentages of sequence identity are referred to in the present application, these percentages are calculated in relation to the full length of the longer sequence, if not specifically indicated otherwise.

Sensory The bioconversion of homofarnesol to (−)-Ambrox according to the present disclosure produces (−)-Ambrox as a predominant compound but may also produce compounds other than (−)-Ambrox which may or may not impart pleasant olfactive notes to the bioconversion mixture and so may contribute in a positive or negative manner to the sensory character of the (−)-Ambrox end product. Accordingly a sensory analysis is carried out using well established sensory tests utilized by trained Experts (eg. Perfumers) so that the testing can assist in determining if a chemically relevant target product is also an olfactively relevant end product relative to a reference product. As the sensory analysis in Example 22 demonstrates, the removal of one of more byproduct compounds from (−)-Ambrox can improve the odor of the remaining compound ((−)-Ambrox) even if the removed compounds are actually odorless compounds per se. That is, an (−)-Ambrox odor enhancement was observed in the absence of compounds II, III and IV.

Aspects of the Invention

1. A process for preparing (−)-Ambrox or a mixture comprising (−)-Ambrox, wherein (3E,7E)-homofarnesol (EEH) or a mixture of stereoisomers comprising EEH is enzymatically converted to (−)-Ambrox or a mixture comprising (−)-Ambrox wherein the enzymatic conversion is carried out using an SHC/HAC enzyme under reaction conditions suitable for the production of (−)-Ambrox and wherein the mixture of stereoisomers comprising EEH consists essentially of homofarnesol isomers selected from the group consisting of [(3E,7E) and [(3Z, 7E)] and/or [(3E,7E) and (3E,7Z)] and/or [(3Z,7E), (3E, 7E) and (3E,7Z)] also designated as [EE:EZ], [EE:ZE] and [EE:EZ:ZE] respectively.

2. A process for preparing (−)-Ambrox or a mixture comprising (−)-Ambrox, wherein (3E,7E)-homofarnesol (EEH) or a mixture of stereoisomers comprising EEH is converted enzymatically to give (−)-Ambrox or a mixture comprising (−)-Ambrox wherein the enzymatic conversion using an SHC/HAC enzyme is carried out under reaction conditions suitable for the production of (−)-Ambrox and wherein if the reaction is carried out in the presence of a solubilizing agent, Triton X-100 or Taurodeoxycholate is not used in combination with a wild-type SHC/HAC enzyme.

3. A process for preparing (−)-Ambrox or a mixture comprising (−)-Ambrox, wherein (3E,7E)-homofarnesol (EEH) or a mixture of stereoisomers comprising EEH is enzymatically converted to (−)-Ambrox or a mixture comprising (−)-Ambrox wherein the enzymatic conversion is carried out using an SHC/HAC enzyme under reaction conditions suitable for the production of (−)-Ambrox and wherein the mixture of stereoisomers comprising EEH consists essentially of homofarnesol isomers selected from the group consisting of [(3E,7E) and[(3Z, 7E)] and/or [(3E,7E) and (3E,7Z)] and/or [(3Z,7E), (3E, 7E) and (3E,7Z)] also designated as [EE:EZ], [EE:ZE] and [EE:EZ:ZE] respectively and wherein the reaction takes place in a three-phase system comprising an aqueous phase, a solid phase and an oil phase.

4. The process according to paragraph 1 or paragraph 2 or paragraph 3 wherein the process is carried out using an SHC/HAC enzyme polypeptide sequence selected from the group consisting of SEQ ID No. 1, SEQ ID No. 2, SEQ ID No. 3; SEQ ID No. 4, or a SHC/HAC derivative selected from Table 1, Table 5, Table 2, Table 6, Table 3, Table 7, Table 4, Table 8 or Table 13, Table 14, or selected from SEQ ID No. 5, 7, 9, 11, 13, 15, 17, 19, 21, 23, 25, 27, 29, 31, 33, 35, 37, 39, 171, 173, 175, 177 and/or 178 or a sequence with at least 30% identity, at least 40% identity, at least 50% identity, or at least 60% identity, or at least 70% identity, or at least 80% identity, or at least 90% identity, or at least 95% identity, or at least 96% identity, or at least 97% identity, or at least 98% identity, or at least 99% identity to SEQ ID No. 1, SEQ ID No. 2, SEQ ID No. 3, or SEQ ID No. 4.

5. The process of any one of paragraphs 1-4 wherein the process uses recombinant host cells producing the SHC/HAC enzyme.

6. The process according to paragraph 4 or paragraph 5 wherein the nucleotide sequence encoding the SHC/HAC enzyme is selected from the group consisting of SEQ ID No. 165, 166, 167, 168, 169 or SEQ ID No. 6, 8, 10, 12, 14, 16, 18, 20, 22, 24, 26, 28, 30, 32, 34, 36, 38, 40 and/or 170, 172, 174 and/or 176.

7. The process according to any one of paragraphs 1-6 wherein the conversion of homofarnesol to (−)-Ambrox takes place at a temperature in the range of from 30° C. to 60° C., at a pH in the range of about 4-8.

8. The process according to any one of paragraphs 1-7 wherein the conversion of homofarnesol to (−)-Ambrox takes place using one or more of the reaction conditions for the wild-type SHC/HAC or SHC/HAC derivative enzymes as set out in Table 24 or Table 24a, preferably at a pH range of 5.0 to 6.2, preferably at a temperature of 35° C.

9. The process according to any one of paragraphs 3-8 wherein the SDS/cell ratio in the range of 10:1 to 20:1, preferably at 16:1 when the ratio of biocatalyst to EEH is about 2:1.

10. The process according to any one of paragraphs 3-9 wherein the weight ratio of biocatalyst to homofarnesol is in the range of from about 0.5-2:1, preferably about 1:1 or 0.5:1.

11. The process according to any one of paragraphs 3-10 wherein the cell growth and bioconversion reaction steps are carried out in the same reaction vessel.

12. The process according to paragraph 2 wherein the homofarnesol substrate comprises one or more homofarnesol stereoisomers.

13. The process according to paragraph 12 wherein the homofarnesol substrate comprises or consists essentially of two homofarnesol stereoisomers.
14. The process according to paragraph 13 wherein the homofarnesol substrate comprises or consists essentially of EE:EZ stereoisomers.
15. The process according to any one of paragraph 14 wherein the homofarnesol comprises or consists essentially of an EE:EZ stereoisomer mixture in the weight ratios selected from the group consisting of: 100:00; 99:01; 98:02; 97:03; 96:04; 95:05; 94:06; 93:07; 92:08; 91:09; 90:10; 89:11; 88:12; 87:13; 86:14; 85:15; 84:16; 83:17; 82:18; 81:19; 80:20; 79:21; 78:22; 77:23; 76:24; 75:25; 74:26; 73:27; 72:28; 71:29 70:30; 69:31; 68:32; 67:33; 66:34; 65:35; 64:36; 63:37; 62:38; 61:39; and 60:40.
16. The process according to paragraph 15 wherein the homofarnesol comprises or consists essentially of an EE:EZ stereoisomer mixture in a weight ratio selected from the group consisting of: EE:EZ 92:8; EE:EZ 90:10; EE:EZ 80:20; EE:EZ 86:14; EE:EZ 70:30; EE:EZ 69:31; and EE:EZ 66:34.
17. The process according to paragraph 15 or paragraph 16 wherein the homofarnesol comprises or consists essentially of an EE:EZ stereoisomer mixture in a weight ratio of 80:20.
18. The process according to any one of paragraphs 1-17 wherein (−)-Ambrox is produced in admixture with at least one or more of the by-products (II), (IV) and/or (III).
19. The process according to any one of paragraphs 1-18 wherein (−)-Ambrox is isolated from the bioconversion reaction mixture using an organic solvent or a steam extraction/distillation step or filtration.
20. The process according to any one of paragraphs 1-19 wherein (−)-Ambrox is isolated from the solid phase of the bioconversion reaction mixture using an organic solvent or a steam extraction/distillation step.
21. The process according to paragraph 19 or paragraph 20 wherein the (−)-Ambrox is isolated from the reaction mixture using an organic solvent.
22. The process according to paragraph 21 wherein (−)-Ambrox is isolated from the reaction mixture using ethanol or toluene.
23. The process according to any one of paragraphs 19-22 wherein the (−)-Ambrox is selectively crystallized using an organic solvent.
24. The process according to paragraph 23 wherein the (−)-Ambrox is substantially free of the by-products (II), (IV) and/or (III).
25. The process according to any one of paragraphs 1-24 wherein (−)-Ambrox in a concentration range of about 125-200 g/l is produced.
26. (−)-Ambrox obtainable by the method of any one of paragraphs 1-25 wherein the (−)-Ambrox has an odor threshold of from about 0.1 to about 0.5 ng/l.
27. The (−)-Ambrox of paragraph 26 in a solid form, preferably an amorphous or crystalline form.
28. A process for making a product containing (−)-Ambrox comprising incorporating the (−)-Ambrox of any one of paragraph 26 or paragraph 27 into the product.
29. The process of paragraph 28 wherein the product is a fragrance product, a cosmetic, a cleaning product, a detergent product or a soap product.
30. A fragrance or cosmetic or consumer care product comprising the (−)-Ambrox of any one of paragraph 26 or paragraph 27.
31. A fragrance or cosmetic or consumer care composition comprising the (−)-Ambrox of paragraph 26 or paragraph 27 and one or more additional components.
32. The use of the (−)-Ambrox of paragraph 26 or paragraph 27 as part of a fragrance or a cosmetic or a consumer product such as a fabric care, toiletry, beauty care and/or a cleaning product.
33. A process for augmenting, enhancing or imparting an aroma in or to a fragrance composition comprising the step of admixing with said fragrance composition, an aroma augmenting or enhancing product produced according to a process comprising the steps of:
(a) preparing a reaction mixture comprising (−)-Ambrox in admixture with one or more of the by-product compounds (II), (III) or (IV).

(II)

(III)

(IV)

(b) extracting (−)-Ambrox in admixture with one or more of the by-product compounds (II), (III) or (IV); and
(c) selectively crystallizing (−)-Ambrox from the extraction mixture; wherein the (−)-Ambrox is prepared by an enzymatic conversion of (3E,7E)-homofarnesol (EEH) or a mixture of stereoisomers comprising EEH using an SHC/HAC enzyme under reaction conditions suitable for the production of (−)-Ambrox and wherein the mixture of stereoisomers comprising EEH consists essentially of homofarnesol isomers selected from the group consisting of [(3E,7E) and [(3Z,7E)] and/or [(3E,7E) and (3E,7Z)] and/or [(3Z,7E), (3E,7E) and (3E,7Z)] also designated as [EE:EZ], [EE:ZE] and [EE:EZ:ZE] respectively.
34. The process of paragraph 33 wherein the reaction takes place in a three-phase system comprising an aqueous phase, a solid phase and an oil phase.
35. The process according to paragraph 33 or paragraph 34 wherein the process is carried out using an SHC/HAC enzyme polypeptide sequence selected from the group consisting of SEQ ID No. 1, SEQ ID No. 2, SEQ ID No. 3; SEQ ID No. 4, or a SHC/HAC derivative selected from Table 1, Table 5, Table 2, Table 6, Table 3, Table 7, Table 4, Table 8 or Table 14, or selected from SEQ ID No. 5, 7, 9, 11, 13, 15, 17, 19, 21, 23, 25, 27, 29, 31, 33, 35, 37, 39, 171, 173, 175 and/or 177 or a sequence with at least 30% identity, at least 40% identity, at least 50% identity, or at least 60% identity, or at least 70% identity, or at least 80% identity, or at least 90% identity, or at least 95% identity, or at least 96% identity, or at least 97% identity, or at least 98% identity, or at least 99% identity to SEQ ID No. 1, SEQ ID No. 2, SEQ ID No. 3, or SEQ ID No. 4.

36. The process of any one of paragraphs 33-35 wherein the process uses recombinant host cells producing the SHC/HAC enzyme.

37. The process according to paragraph 35 or paragraph 36 wherein the nucleotide sequence encoding the SHC/HAC enzyme is selected from the group consisting of SEQ ID No. 165, 166, 167, 168, 169 or SEQ ID No. 6, 8, 10, 12, 14, 16, 18, 20, 22, 24, 26, 28, 30, 32, 34, 36, 38, 40 and/or 170, 172, 174 and/or 176.

38. The process according to any one of paragraphs 33-37 wherein the conversion of homofarnesol to (−)-Ambrox takes place at a temperature in the range of from 30° C. to 60° C., at a pH in the range of about 4-8.

39. The process according to any one of paragraphs 33-38 wherein the conversion of homofarnesol to (−)-Ambrox takes place using one or more of the reaction conditions for the wild-type SHC/HAC or SHC/HAC derivative enzymes as set out in Table 24 or Table 24a, preferably at a pH range of 5.0 to 6.2, preferably at a temperature of 35° C.

40. The process according to any one of paragraphs 34-39 wherein the SDS/cell ratio in the range of 10:1 to 20:1, preferably at 16:1 when the ratio of biocatalyst to EEH is about 2:1.

41. The process according to any one of paragraphs 34-40 wherein the weight ratio of biocatalyst to homofarnesol is in the range of from about 0.5-2:1, preferably about 1:1 or 0.5:1.

42. The process according to any one of paragraphs 34-41 wherein the cell growth and bioconversion reaction steps are carried out in the same reaction vessel.

43. The process according to any one of paragraphs 33-42 wherein the homofarnesol comprises or consists essentially of an EE:EZ stereoisomer mixture in the weight ratios selected from the group consisting of: 100:00; 99:01; 98:02; 97:03; 96:04; 95:05; 94:06; 93:07; 92:08; 91:09; 90:10; 89:11; 88:12; 87:13; 86:14; 85:15; 84:16; 83:17; 82:18; 81:19; 80:20; 79:21; 78:22; 77:23; 76:24; 75:25; 74:26; 73:27; 72:28; 71:29 70:30; 69:31; 68:32; 67:33; 66:34; 65:35; 64:36; 63:37; 62:38; 61:39; and 60:40.

44. The process according to paragraph 43 wherein the homofarnesol comprises or consists essentially of an EE:EZ stereoisomer mixture in a weight ratio selected from the group consisting of: EE:EZ 92:08; EE:EZ 90:10; EE:EZ 80:20; EE:EZ 86:14; EE:EZ 70:30; EE:EZ 69:31; and EE:EZ 66:34.

45. The process according to paragraph 43 or paragraph 44 wherein the homofarnesol comprises or consists essentially of an EE:EZ stereoisomer mixture in a weight ratio of 80:20.

46. The process according to any one of paragraphs 33-45 wherein (−)-Ambrox is produced in admixture with at least one or more of the by-products (II), (IV) and/or (III).

47. The process according to any one of paragraphs 33-46 wherein (−)-Ambrox is isolated from the bioconversion reaction mixture using an organic solvent or a steam extraction/distillation step or filtration.

48. The process according to any one of paragraphs 33-47 wherein (−)-Ambrox is isolated from the solid phase of the bioconversion reaction mixture using an organic solvent or a steam extraction/distillation step.

49. The process according to paragraph 47 or paragraph 48 wherein the (−)-Ambrox is isolated from the reaction mixture using an organic solvent.

50. The process according to paragraph 49 wherein (−)-Ambrox is isolated from the reaction mixture using ethanol or toluene.

51. The process according to any one of paragraphs 47-49 wherein the (−)-Ambrox is selectively crystallized using an organic solvent.

52. The process according to paragraph 51 wherein the (−)-Ambrox is substantially free of the by-products (II), (IV) and/or (III).

53. The process according to any one of paragraphs 33-52 wherein (−)-Ambrox in a concentration range of about 125-200 g/l is produced.

54. The process according to any one of paragraphs 33-53 wherein the (−)-Ambrox has an odor threshold of from about 0.1 to about 0.5 ng/l.

Additional Aspects of the Invention

1. A squalene hopene cyclase (SHC)/homofarnesol Ambrox cyclase (HAC) derivative comprising an amino acid sequence having from 1-50 mutations independently selected from substitutions, deletions or insertions relative to SEQ ID No. 1.

2. The SHC/HAC derivative according to paragraph 1 wherein the SHC derivative comprises an amino acid sequence having from 1 to 40 mutations, from 1-30 mutations, from 1-20 mutations, from 1-10 mutations or from 1-6 mutations relative to SEQ ID No. 1.

3. The SHC/HAC derivative according to paragraph 1 or paragraph 2 wherein the SHC/HAC derivative comprises an amino acid sequence having at least 40% identity, at least 50% identity, or at least 60% identity, or at least 70% identity, or at least 80% identity, or at least 90% identity, or at least 95% identity, or at least 96% identity, or at least 97% identity, or at least 98% identity, or at least 99% identity relative to SEQ ID No. 1.

4. The SHC/HAC derivative according to paragraph 3 wherein the SHC variant comprises an amino acid sequence having at least 95% identity to SEQ ID No. 1.

5. A SHC/HAC derivative comprising 1-10 mutations independently selected from substitutions, deletions or insertions relative to SEQ ID No. 1 wherein the one or more mutations other than an SHC active site mutation is/are located in domain 2 of the SHC enzyme (FIGS. 19 and/or 20).

6. The SHC/HAC derivative according to any one of paragraphs 1-5 wherein the one or more mutations relative to SEQ ID No. 1 are selected from Table 1 wherein if only one mutation is selected it is not F601Y.

7. The SHC/HAC derivative of paragraph 6 wherein at least 2, 3, 4, 5, 6, 7, 8, 9 or 10 mutations are selected from Table 1 or Table 5.

8. The SHC/HAC derivative of paragraph 2 comprising an amino acid sequence that has up to 6 mutations relative to SEQ ID No. 1 and comprises at least the substitutions F601Y or M132R in combination with at least any one or more of F129L and/or I432T.

9. The SHC/HAC derivative of paragraph 7 comprising an amino acid sequence which has up to 8 amino acid alterations relative to SEQ ID No. 1 and comprises one or more than one amino acid alteration in a position selected from the group consisting of positions 77, 129, 132, 192, 224, 432, 579, 601 and 605 relative to SEQ ID No. 1 wherein the SHC/HAC derivative has an increased HAC enzymatic activity relative to SEQ ID No. 1.

10. The SHC/HAC derivative according to paragraph 9 comprising one or more substitutions selected from the group consisting of: T77A, F129L, M132R, I92V, A224V, I432T, Q579H, F601Y and/or F605W relative to SEQ ID No. 1.
11. The SHC/HAC derivative according to paragraph 10 comprising F601Y.
12. The SHC/HAC derivative according to paragraph 10 comprising F129L.
13. The SHC/HAC derivative according to paragraph 10 comprising F601Y and F129L.
14. The SHC/HAC derivative according to paragraph 10 comprising M132R and I432T.
15. The SHC/HAC derivative according to paragraph 14 further comprising the amino acid substitution A224V.
16. The SHC/HAC derivative according to paragraph 14 further comprising F601Y.
17. The SHC/HAC derivative according to paragraph 14 further comprising F129L.
18. The SHC/HAC derivative according to paragraph 17 further comprising F601Y.
19. The SHC/HAC derivative according to paragraph 11 further comprising Q579H.
20. The SHC derivative according to paragraph 10 comprising T77A and I92V and F129L.
21. The SHC/HAC derivative according to any one of the preceding paragraphs having the amino acid sequence selected from the group consisting of SEQ ID No. 5, 7, 9, 11, 13, 15, 17, 19, 21, 23, 25, 27, 29, 31, 33, 35, 37, 39 and/or 171.
22. An isolated nucleotide sequence encoding the SHC derivative according to any one of paragraphs 1-21.
23. The isolated nucleotide sequence according to paragraph 22 wherein the nucleotide sequence is selected from the group consisting of SEQ ID No. 6, 8, 10, 12, 14, 16, 18, 20, 22, 24, 26, 28, 30, 32, 34, 36, 38, 40 and/or 170.
24. A construct comprising the nucleotide sequence of paragraph 22 or paragraph 23.
25. A construct according to paragraph 24 comprising a promoter functionally linked to the nucleotide sequence of paragraph 22 or 23.
26. The construct of paragraph 25 wherein the promoter is an inducible or a constitutive promoter.
27. A vector comprising the construct according to any one of paragraphs 24-26.
28. The vector of paragraph 27 wherein the vector is a plasmid.
29. The vector according to paragraph 28 capable of directing expression in host cells selected from prokaryotic, yeast, plant and insect host cells.
30. The construct of any one of paragraphs 24-26 or the vector according to any one of paragraphs 27-29 wherein the construct or the vector is capable of integration into the genome of a host cell selected from prokaryotic, yeast, plant and insect host cells.
31. A recombinant host cell comprising a nucleotide sequence according to paragraph 22 or 23 or a construct according to any one of paragraphs 24-26 or 30 or a vector according to any one of paragraphs 27-30.
32. The recombinant host cell according to paragraph 31 wherein the host cell is selected from the group of prokaryotic host cells consisting of the bacteria of the genus *Escherichia, Streptomyces, Bacillus, Pseudomonas, Lactobacillus* and *Lactococcus*.
33. The recombinant host cell of paragraph 32 wherein the host cell is an *E. coli* host cell.
34. The recombinant host cell of paragraph 33 wherein the host cell overexpresses the gene encoding the SHC/HAC derivative.
35. A method of preparing the SHC/HAC derivative according to any one of para-graphs 1-21 comprising the step of culturing one or more recombinant host cells according to any one of paragraphs 31-34 under conditions which permit production of the SHC/HAC derivative enzyme.
36. The method of paragraph 35 wherein the cell culture takes place under conditions suitable for biocatalyst production.
37. A method of preparing (−)-Ambrox comprising converting homofarnesol to (−)-Ambrox using a recombinant host cell according to any one of paragraphs 31-34 or by using a recombinant host cell comprising SEQ ID No. 169 or SEQ ID No. 165 encoding a WT SHC/HAC wherein if a WT SHC/HAC is used, the bioconversion of homofarnesol to (−)-Ambrox is carried out with a solubilizing agent other than Triton X-100 or Taurodeoxycholate.
38. The method according to paragraph 37 wherein the conversion of homofarnesol to (−)-Ambrox under suitable bioconversion reaction conditions for the WT SHC/HAC or the SHC/HAC derivative enzyme.
39. The method according to paragraph 37 or 38 wherein the conversion of homofarnesol to (−)-Ambrox takes place under suitable pH, temperature, solubilizing agent concentrations for the WT SHC/HAC or the SHC/HAC derivative enzyme.
40. The method according to paragraph 39 wherein the conversion of homofarnesol to (−)-Ambrox takes place at a temperature in the range of from 30° C. to 60° C., at a pH in the range of about 4-8 and in the presence of a solubilizing agent other than Triton X-100 or Taurodeoxycholate for the WT SHC/HAC enzyme.
41. The method according to any one of paragraphs 37-40 wherein the conversion of homofarnesol to (−)-Ambrox takes place using one or more of the reaction conditions for the WT SHC/HAC or SHC/HAC derivative enzyme as set out in Table 24 or Table 24a.
42. The method of any one of paragraphs 37-41 wherein the weight ratio of biocatalyst to homofarnesol is in the range of from about 0.5:1 to 2:1 preferably about 1:1 or 0.5:1.
43. The method according to any one of paragraphs 37-42 wherein the cell growth and bioconversion reaction steps are carried out in the same reaction vessel.
44. The method according to any one of paragraphs 37-43 wherein the homofarnesol substrate comprises one or more homofarnesol stereoisomers.
45. The method of paragraph 44 wherein the homofarnesol substrate comprises two homofarnesol stereoisomers.
46. The method of paragraph 45 wherein the homofarnesol substrate comprises EE:EZ stereoisomers.
47. The method according to any one of paragraphs 44-46 wherein the homofarnesol comprises an EE:EZ stereoisomer mixture in the weight ratios selected from the group consisting of: 100:00; 99:01; 98:02; 97:03; 96:04; 95:05; 94:06; 93:07; 92:08; 91:09; 90:10; 89:11; 88:12; 87:13; 86:14; 85:15; 84:16; 83:17; 82:18; 81:19; 80:20; 79:21; 78:22; 77:23; 76:24; 75:25; 74:26; 73:27; 72:28; 71:29 and 70:30.
48. The method of paragraph 47 wherein the homofarnesol comprises an EE:EZ stereoisomer mixture in a weight ratio is selected from the group consisting of: EE:EZ 90:10; EE:EZ 80:20; EE:EZ 86:14; EE:EZ 70:30; EE:EZ 69:31; and EE:EZ 66:34.

49. The method of paragraph 35 or 36 wherein the homofarnesol comprises an EE:EZ stereoisomer mixture in a weight ratio of 80:20.
50. The method of any one of paragraphs 37-49 wherein (−)-Ambrox is produced in admixture with one or more of the by-products (II), (IV) and/or (III).
51. The method of any one of paragraphs 37-50 wherein (−)-Ambrox is isolated from the bioconversion reaction mixture using an organic solvent or a steam extraction/distillation step or (−)-Ambrox crystals are isolated directly from the bioconversion reaction mixture by means of filtration.
52. The method according to paragraph 51 wherein (−)-Ambrox is isolated from the reaction mixture using an organic solvent.
53. The method of paragraph 52 wherein the (−)-Ambrox is selectively crystallized using an organic solvent.
54. The method of paragraph 52 or 53 wherein the (−)-Ambrox is substantially free of the by-products (II), (IV) and/or (III).
55. (−)-Ambrox obtainable by the method of any one of paragraphs 51-54.
56. The (−)-Ambrox of paragraph 55 in a solid form, preferably in an amorphous or crystalline form.
57. A method for making a product containing (−)-Ambrox comprising incorporating the (−)-Ambrox of paragraph 55 or 56 into the product, preferably a fragrance product, a cosmetic product, a cleaning product, a detergent product or a soap product.
58. A fragrance or cosmetic or a consumer care product comprising the (−)-Ambrox of paragraph 55 or 56.
59. A fragrance or cosmetic or consumer care composition comprising the (−)-Ambrox of paragraph 55 or 56 and one or more additional components.
60. The use of the (−)-Ambrox of paragraph 55 or 56 as part of a fragrance or a cosmetic or a consumer product such as a fabric care, toiletry, beauty care and/or a cleaning product.
61. The use of a SHC/HAC derivative enzyme according to any one of paragraphs 1-21, a nucleotide sequence according to paragraphs 22 or 23, a construct according to any one of paragraphs 24-26 or 30, a vector according to any one of paragraphs 27-30 or a recombinant host cell according to any one of paragraphs 31-34 or a recombinant host cell expressing a WT SHC/HAC for the bioconversion of homofarnesol to (−)-Ambrox wherein the WT SHC/HAC enzyme is used with a solubilizing agent other than Triton X-100 for the bioconversion reaction.
62. A process for preparing (−)-Ambrox or a stereoisomer mixture of (−)-Ambrox, wherein (3E,7E)-homofarnesol or a stereoisomer mixture of (3E,7E)-homofarnesol is converted enzymatically to give (−)-Ambrox or a stereoisomer mixture of (−)-Ambrox wherein the enzymatic conversion using an SHC/HAC enzyme is carried out under reaction conditions suitable for the production of (−)-Ambrox and wherein if the reaction is carried out in the presence of a solubilizing agent Triton X-100 is not used in combination with a WT SHC/HAC enzyme.
63. The process according to paragraph 62 wherein the process is carried out using an SHC/HAC enzyme is selected from the group consisting of AacSHC (SEQ ID No. 1), Zmo SHC1 (SEQ ID No. 2), ZmoSHC2, (SEQ ID No. 3); BjpSHC (SEQ ID No. 4), a SHC/HAC derivative selected from Table 1, Table 5, Table 2, Table 6, Table 3, Table 7, Table 4 and/or Table 8, or a sequence with at least 30% identity, at least 40% identity, at least 50% identity, or at least 60% identity, or at least 70% identity, or at least 80% identity, or at least 90% identity, or at least 95% identity, or at least 96% identity, or at least 97% identity, or at least 98% identity, or at least 99% identity relative to SEQ ID No. 1, SEQ ID No. 2, SEQ ID No. 3, and/or SEQ ID No. 4.
64. The process according to paragraph 63 wherein the conversion of homofarnesol to (−)-Ambrox takes place at a temperature in the range of from 30° C. to 60° C., at a pH in the range of 4-8 and in the presence of a solubilizing agent other than Triton X-100 for the WT SHC.
65. The process according to paragraph 64 wherein the reaction conditions for the WT SHC/HAC or each SHC/HAC derivative as set out in Table 24 or Table 24a are used.
66. The process according to any one of paragraphs 62-65 wherein the process comprises (a) culturing one or more recombinant host cells expressing a WT SHC or SHC derivative enzyme under conditions which permit expression of the WT SHC or SHC/HAC derivative polypeptide prior to the conversion of E,E-homofarnesol to (−)-Ambrox.
67. The process according to paragraph 66 wherein the culturing step and subsequence conversion step takes place in the same reaction vessel under different reaction conditions.
68. The process according to paragraph 67 wherein the culturing step is at a pH range of about 6 to about 7 and the homofarnesol to (−)-Ambrox step is at a pH range of about 4.8-5.5.
69. The process according to any one of paragraphs 62-68 wherein the homofarnesol substrate comprises EE:EZ stereoisomers.
70. The process according to paragraph 69 wherein the homofarnesol comprises an EE:EZ stereoisomer mixture in a weight ratio is selected from the group consisting of: EE:EZ 90:10; EE:EZ 80: 20; EE:EZ 86:14; EE:EZ 70:30; EE:EZ 69:31; and EE:EZ 66:34.
71. The process of paragraph 70 wherein the homofarnesol comprises EE:EZ in a weight ratio of 80:20.
72. The method of any one of paragraphs 62-71 wherein (−)-Ambrox is produced in admixture with one or more of the by-products (II), (IV) and/or (III).
73. The method of any one of paragraphs 62-72 wherein (−)-Ambrox is isolated from the reaction mixture using an organic solvent or a steam extraction/distillation step or filtration.
74. The method according to paragraph 73 wherein (−)-Ambrox is isolated from the reaction mixture using an organic solvent.
75. The method of paragraph 74 wherein (−)-Ambrox is selectively crystallized using an organic solvent.
76. The method of paragraph 74 or 75 wherein the (−)-Ambrox is substantially free of the by-products (II), (IV) and/or (III).
77. (−)-Ambrox obtainable by the method of any one of paragraphs 72-76.
78. The (−)-Ambrox of paragraph 26 in a solid form, preferably in an amorphous or crystalline form.
79. A method for making a product comprising incorporating the (−)-Ambrox of paragraphs 77 or 78 into the product.
80. The method of paragraph 79 wherein the product is a fragrance product, a cosmetic product, a cleaning product, a detergent product or a soap product.
81. A fragrance or cosmetic or a consumer care product comprising the (−)-Ambrox of paragraph 77 or 78.

82. A fragrance or cosmetic or consumer care composition comprising the (−)-Ambrox of paragraph 77 or 78 and an additional component.
83. The use of the (−)-Ambrox of paragraph 77 or 78 as part of a fragrance or cosmetic consumer care product.

Additional Aspects of the Invention (ZmoSHC1)

1. A squalene hopene cyclase (SHC)/homofarnesol Ambrox cyclase (HAC) derivative comprising an amino acid sequence having from 1-50 mutations independently selected from substitutions, deletions or insertions relative to SEQ ID No. 2.
2. The SHC/HAC derivative according to paragraph 1 wherein the SHC derivative comprises an amino acid sequence having from 1 to 40 mutations, from 1-30 mutations, from 1-20 mutations, from 1-10 mutations or from 1-6 mutations relative to SEQ ID No. 2.
3. The SHC/HAC derivative according to paragraph 1 or paragraph 2 wherein the SHC/HAC derivative comprises an amino acid sequence having at least 40% identity, at least 50% identity, or at least 60% identity, or at least 70% identity, or at least 80% identity, or at least 90% identity, or at least 95% identity, or at least 96% identity, or at least 97% identity, or at least 98% identity, or at least 99% identity relative to SEQ ID No. 2.
4. The SHC/HAC derivative according to paragraph 3 wherein the SHC variant comprises an amino acid sequence having at least 95% identity to SEQ ID No. 2.
5. A SHC/HAC derivative comprising 1-10 mutations independently selected from substitutions, deletions or insertions relative to SEQ ID No. 2 wherein the one or more mutations other than an SHC active site mutation is/are located in domain 2 of the SHC enzyme (FIGS. 19 and/or 20).
6. The SHC/HAC derivative according to any one of paragraphs 1-5 wherein the one or more mutations relative to SEQ ID No. 2 are selected from Table 2 wherein if only one mutation is selected it is not F668Y.
7. The SHC/HAC derivative of paragraph 6 wherein at least 2, 3, 4, 5, 6, 7, 8, 9 or 10 mutations are selected from Table 2 and/or Table 6.
8. The SHC/HAC derivative of paragraph 2 comprising an amino acid sequence that has up to 6 mutations relative to SEQ ID No 2 and comprises at least the substitutions F668Y or Y185R in combination with at least any one or more of F182L and/or I498T.
9. The SHC/HAC derivative of paragraph 7 comprising an amino acid sequence which has up to 8 amino acid alterations relative to SEQ ID No. 2 and comprises one or more one amino acid alteration in a position selected from the group consisting of positions 129, 145, 182, 185, 282, 498, 647 and 668 relative to SEQ ID No. 2 wherein the SHC/HAC derivative has an increased HAC enzymatic activity relative to SEQ ID No. 2.
10. The SHC/HAC derivative according to paragraph 9 comprising one or more substitutions selected from the group consisting of: S129A, V145V, F182L, Y185R, G282V, I498T, H646H and F668Y relative to SEQ ID No. 2.
11. The SHC/HAC derivative according to paragraph 10 comprising F668Y.
12. The SHC/HAC derivative according to paragraph 10 comprising F182L.
13. The SHC/HAC derivative according to paragraph 10 comprising F668Y and F182L.
14. The SHC/HAC derivative according to paragraph 10 comprising Y185R and I498T.
15. The SHC/HAC derivative according to paragraph 14 further comprising G282V.
16. The SHC/HAC derivative according to paragraph 14 further comprising F668Y.
17. The SHC/HAC derivative according to paragraph 14 further comprising F182L.
18. The SHC/HAC derivative according to paragraph 17 further comprising F668Y.
19. The SHC/HAC derivative according to paragraph 11 further comprising H646H.
20. The SHC derivative according to paragraph 10 comprising S129A and V145V and F182L.
21. The SHC/HAC derivative according to any one of the preceding paragraphs having the amino acid sequence selected from the group consisting of SEQ ID No. 41, 43, 45, 47, 49, 51, 53, 55, 57, 59, 61, 63, 65, 67, 69, 71, 73 and/or 75.
22. An isolated nucleotide sequence encoding the SHC derivative according to any one of paragraphs 1-21.
23. The isolated nucleotide sequence according to paragraph 22 wherein the nucleotide sequence is selected from the group consisting of SEQ ID No. 42, 44, 46, 48, 50, 52, 54, 56, 58, 60, 62, 64, 66, 68, 70, 72, 74 and/or 76.
24. A construct comprising the nucleotide sequence of paragraph 22 or paragraph 23.
25. A construct according to paragraph 24 comprising a promoter functionally linked to the nucleotide sequence of paragraph 22 or 23.
26. The construct of paragraph 25 wherein the promoter is an inducible or a constitutive promoter.
27. A vector comprising the construct according to any one of paragraphs 24-26.
28. The vector of paragraph 27 wherein the vector is a plasmid.
29. The vector according to paragraph 28 capable of directing expression in host cells selected from prokaryotic, yeast, plant and insect host cells.
30. The construct of any one of paragraphs 24-26 or the vector according to any one of paragraphs 27-29 wherein the construct or the vector is capable of integration into the genome of a host cell selected from prokaryotic, yeast, plant and insect host cells.
31. A recombinant host cell comprising a nucleotide sequence according to paragraph 22 or 23 or a construct according to any one of paragraphs 24-26 or 30 or a vector according to any one of paragraphs 27-30.
32. The recombinant host cell according to paragraph 31 wherein the host cell is selected from the group of prokaryotic host cells consisting of the bacteria of the genus *Escherichia*, *Streptomyces*, *Bacillus*, *Pseudomonas*, *Lactobacillus* and *Lactococcus*.
33. The recombinant host cell of paragraph 32 wherein the host cell is an *E. coli* host cell.
34. The recombinant host cell of paragraph 33 wherein the host cell overexpresses the gene encoding the SHC/HAC derivative.
35. A method of preparing the SHC/HAC derivative according to any one of paragraphs 1-21 comprising the step of culturing one or more recombinant host cells according to any one of paragraphs 31-34 under conditions which permit production of the SHC/HAC derivative enzyme.
36. The method of paragraph 35 wherein the cell culture takes place under conditions suitable for biocatalyst production.
37. A method of preparing (−)-Ambrox comprising converting homofarnesol to (−)-Ambrox using a recombinant host cell according to any one of paragraphs 31-34 or by using a recombinant host cell comprising SEQ ID No.166 encoding a WT SHC/HAC wherein if a WT SHC/HAC is used, the bioconversion of homofarnesol to (−)-Ambrox is carried out with a solubilizing agent other than Triton X-100.

38. The method according to paragraph 37 wherein the conversion of homofarnesol to (−)-Ambrox under suitable bioconversion reaction conditions for the WT SHC/HAC or the SHC/HAC derivative enzyme.

39. The method according to paragraph 37 or 38 wherein the conversion of homofarnesol to (−)-Ambrox takes place under suitable pH, temperature, solubilizing agent concentrations for the WT SHC/HAC or the SHC/HAC derivative enzyme.

40. The method according to paragraph 39 wherein the conversion of homofarnesol to (−)-Ambrox takes place at a temperature in the range of from 30° C. to 60° C., at a pH in the range of about 4-8 and in the presence of a solubilizing agent other than Triton X-100 for the WT SHC/HAC enzyme.

41. The method according to any one of paragraphs 37-40 wherein the conversion of homofarnesol to (−)-Ambrox takes place using one or more of the reaction conditions for the WT SHC/HAC or SHC/HAC derivative enzyme as set out in Table 24 or Table 24a.

42. The method of any one of paragraphs 37-41 wherein the weight ratio of biocatalyst to homofarnesol is in the range of from about 0.5:1 to 2:1, preferably about 1:1 or 0.5:1.

43. The method according to any one of paragraphs 37-42 wherein the cell growth and bioconversion reaction steps are carried out in the same reaction vessel.

44. The method according to any one of paragraphs 37-43 wherein the homofarnesol substrate comprises one or more homofarnesol stereoisomers.

45. The method of paragraph 44 wherein the homofarnesol substrate comprises two homofarnesol stereoisomers.

46. The method of paragraph 45 wherein the homofarnesol substrate comprises EE:EZ stereoisomers.

47. The method according to any one of paragraphs 44-46 wherein the homofarnesol comprises an EE:EZ stereoisomer mixture in the weight ratios selected from the group consisting of: 100:00; 99:01; 98:02; 97:03; 96:04; 95:05; 94:06; 93:07; 92:08; 91:09; 90:10; 89:11; 88:12; 87:13; 86:14; 85:15; 84:16; 83:17; 82:18; 81:19; 80:20; 79:21; 78:22; 77:23; 76:24; 75:25; 74:26; 73:27; 72:28; 71:29 and 70:30.

48. The method of paragraph 47 wherein the homofarnesol comprises an EE:EZ stereoisomer mixture in a weight ratio is selected from the group consisting of: EE:EZ 90:10; EE:EZ 80:20; EE:EZ 86:14; EE:EZ 70:30; EE:EZ 69:31; and EE:EZ 66:34.

49. The method paragraph 35 or 36 wherein the homofarnesol comprises an EE:EZ stereoisomer mixture in a weight ratio of 80:20.

50. The method of any one of paragraphs 37-49 wherein (−)-Ambrox is produced in admixture with one or more of the by-products (II), (IV) and/or (III).

51. The method of any one of paragraphs 37-50 wherein (−)-Ambrox is isolated from the bioconversion reaction mixture using an organic solvent or a steam extraction/distillation step, or filtration.

52. The method according to paragraph 51 wherein (−)-Ambrox is isolated from the reaction mixture using an organic solvent.

53. The method of paragraph 52 wherein the (−)-Ambrox is selectively crystallized from (−)-Ambrox using an organic solvent.

54. The method of paragraph 52 or 53 wherein the (−)-Ambrox is substantially free of the by-products (II), (IV) and/or (III).

55. (−)-Ambrox obtainable by the method of any one of paragraphs 51-54.

56. The (−)-Ambrox of paragraph 55 in a solid form, prefereably in an amorphous or crystalline form.

57. A method for making a product containing (−)-Ambrox comprising incorporating the (−)-Ambrox of paragraph 55 or 56 into the product, preferably a fragrance product, a cosmetic product, a cleaning product, a detergent product or a soap product.

58. A fragrance or cosmetic or a consumer care product comprising the (−)-Ambrox of paragraph 55 or 56.

59. A fragrance or cosmetic or consumer care composition comprising the (−)-Ambrox of paragraph 55 or 56 and one or more additional components.

60. The use of the (−)-Ambrox of paragraph 55 or 56 as part of a fragrance or a cosmetic or a consumer product such as a fabric care, toiletry, beauty care and/or a cleaning product.

61. The use of a SHC/HAC derivative enzyme according to any one of paragraphs 1-21, a nucleotide sequence according to paragraphs 22 or 23, a construct according to any one of paragraphs 24-26 or 30, a vector according to any one of paragraphs 27-30 or a recombinant host cell according to any one of paragraphs 31-34 or a recombinant host cell expressing a WT SHC/HAC for the bioconversion of homofarnesol to (−)-Ambrox wherein the WT SHC/HAC enzyme is used with a solubilizing agent other than Triton X-100 for the bioconversion reaction.

Further Aspects of the Invention (ZmoSHC2)

1. A squalene hopene cyclase (SHC)/homofarnesol Ambrox cyclase (HAC) derivative comprising an amino acid sequence having from 1-50 mutations independently selected from substitutions, deletions or insertions relative to SEQ ID No. 3.

2. The SHC/HAC derivative according to paragraph 1 wherein the SHC derivative comprises an amino acid sequence having from 1 to 40 mutations, from 1-30 mutations, from 1-20 mutations, from 1-10 mutations or from 1-6 mutations relative to SEQ ID No. 3.

3. The SHC/HAC derivative according to paragraph 1 or paragraph 2 wherein the SHC/HAC derivative comprises an amino acid sequence having at least 40% identity, at least 50% identity, or at least 60% identity, or at least 70% identity, or at least 80% identity, or at least 90% identity, or at least 95% identity, or at least 96% identity, or at least 97% identity, or at least 98% identity, or at least 99% identity relative to SEQ ID No. 3.

4. The SHC/HAC derivative according to paragraph 3 wherein the SHC variant comprises an amino acid sequence having at least 95% identity to SEQ ID No. 3.

5. A SHC/HAC derivative comprising 1-10 mutations independently selected from substitutions, deletions or insertions relative to SEQ ID No. 3 wherein the one or more mutations other than an SHC active site mutation is/are located in domain 2 of the SHC enzyme (FIGS. 19 and/or 20).

6. The SHC/HAC derivative according to any one of paragraphs 1-5 wherein the one or more mutations relative to SEQ ID No. 3 are selected from Table 3 wherein if only one mutation is selected it is not F620Y.

7. The SHC/HAC derivative of paragraph 6 wherein at least 2, 3, 4, 5, 6, 7, 8, 9 or 10 mutations are selected from Table 3 and/or Table 7.

8. The SHC/HAC derivative of paragraph 2 comprising an amino acid sequence that has up to 6 mutations relative to SEQ ID No. 3 and comprises at least the substitutions F620Y or I140R in combination with at least any one or more of F137L and/or I450T.
9. The SHC/HAC derivative of paragraph 7 comprising an amino acid sequence which has up to 8 amino acid alterations relative to SEQ ID No. 3 and comprises one or more one amino acid alteration in a position selected from the group consisting of positions 85, 100, 137, 140, 233, 450, 598 and 620 relative to SEQ ID No. 3 wherein the SHC/HAC derivative has an increased HAC enzymatic activity relative to SEQ ID No. 3.
10. The SHC/HAC derivative according to paragraph 9 comprising one or more substitutions selected from the group consisting of: G85A, V100V, F137L, I140R, V233V, I450T, N598H and F620Y relative to SEQ ID No. 3.
11. The SHC/HAC derivative according to paragraph 10 comprising F620Y.
12. The SHC/HAC derivative according to paragraph 10 comprising F137L.
13. The SHC/HAC derivative according to paragraph 10 comprising F620Y and F137L.
14. The SHC/HAC derivative according to paragraph 10 comprising I140R and I450T.
15. The SHC/HAC derivative according to paragraph 14 further comprising V233V.
16. The SHC/HAC derivative according to paragraph 14 further comprising F620Y.
17. The SHC/HAC derivative according to paragraph 14 further comprising F137L.
18. The SHC/HAC derivative according to paragraph 17 further comprising F620Y.
19. The SHC/HAC derivative according to paragraph 11 further comprising N598H.
20. The SHC derivative according to paragraph 10 comprising G85A and V100V and F137L.
21. The SHC/HAC derivative according to any one of the preceding paragraphs having the amino acid sequence selected from the group consisting of SEQ ID No. 77, 79, 81, 83, 85, 87, 89, 91, 93, 95, 97, 99, 101, 103, 105, 107, 109 and/or 111.
22. An isolated nucleotide sequence encoding the SHC derivative according to any one of paragraphs 1-21.
23. The isolated nucleotide sequence according to paragraph 22 wherein the nucleotide sequence is selected from the group consisting of SEQ ID No. 78, 80, 82, 84, 86, 88, 90, 92, 94, 96, 98, 100, 102, 104, 106, 108, 110 and/or 112.
24. A construct comprising the nucleotide sequence of paragraph 22 or paragraph 23.
25. A construct according to paragraph 24 comprising a promoter functionally linked to the nucleotide sequence of paragraph 22 or 23.
26. The construct of paragraph 25 wherein the promoter is an inducible or a constitutive promoter.
27. A vector comprising the construct according to any one of paragraphs 24-26.
28. The vector of paragraph 27 wherein the vector is a plasmid.
29. The vector according to paragraph 28 capable of directing expression in host cells selected from prokaryotic, yeast, plant and insect host cells.
30. The construct of any one of paragraphs 24-26 or the vector according to paragraphs 27-29 wherein the construct or the vector is capable of integration into the genome of a host cell selected from prokaryotic, yeast, plant and insect host cells.
31. A recombinant host cell comprising a nucleotide sequence according to paragraph 22 or 23 or a construct according to any one of paragraphs 24-26 or 30 or a vector according to any one of paragraphs 27-30.
32. The recombinant host cell according to paragraph 31 wherein the host cell is selected from the group of prokaryotic host cells consisting of the bacteria of the genus *Escherichia, Streptomyces, Bacillus, Pseudomonas, Lactobacillus* and *Lactococcus*.
33. The recombinant host cell of paragraph 32 wherein the host cell is an *E. coli* host cell.
34. The recombinant host cell of paragraph 33 wherein the host cell overexpresses the gene encoding the SHC/HAC derivative.
35. A method of preparing the SHC/HAC derivative according to any one of paragraphs 1-21 comprising the steps of:
(a) culturing one or more recombinant host cells according to any one of paragraphs 31-34 under conditions which permit production of the SHC/HAC derivative enzyme.
36. The method of paragraph 35 wherein the cell culture takes place under conditions suitable for biocatalyst production.
37. A method of preparing (−)-Ambrox comprising converting homofarnesol to (−)-Ambrox using a recombinant host cell according to any one of paragraphs 31-34 or by using a recombinant host cell comprising SEQ ID No. 167 encoding a WT SHC/HAC wherein if a WT SHC/HAC is used, the bioconversion of homofarnesol to (−)-Ambrox is carried out with a solubilizing agent other than Triton X-100.
38. The method according to paragraph 37 wherein the conversion of homofarnesol to (−)-Ambrox under suitable bioconversion reaction conditions for the WT SHC/HAC or the SHC/HAC derivative enzyme.
39. The method according to paragraph 37 or 38 wherein the conversion of homofarnesol to (−)-Ambrox takes place under suitable pH, temperature, solubilizing agent concentrations for the WT SHC/HAC or the SHC/HAC derivative enzyme.
40. The method according to paragraph 39 wherein the conversion of homofarnesol to (−)-Ambrox takes place at a temperature in the range of from 30° C. to 60° C., at a pH in the range of about 4-8 and in the presence of a solubilizing agent other than Triton X-100 for the WT SHC/HAC enzyme.
41. The method according to any one of paragraphs 37-40 wherein the conversion of homofarnesol to (−)-Ambrox takes place using one or more of the reaction conditions for the WT SHC/HAC or SHC/HAC derivative enzyme as set out in Table 24 or Table 24a.
42. The method of any one of paragraphs 37-41 wherein the weight ratio of biocatalyst to homofarnesol is in the range of from about 0.5:1 to 2:1, preferably about 1:1 or 0.5:1.
43. The method according to any one of paragraphs 37-42 wherein the cell growth and bioconversion reaction steps are carried out in the same reaction vessel.
44. The method according to paragraphs 37-43 wherein the homofarnesol substrate comprises one or more homofarnesol stereoisomers.
45. The method of paragraph 44 wherein the homofarnesol substrate comprises two homofarnesol stereoisomers.
46. The method of paragraph 45 wherein the homofarnesol substrate comprises EE:EZ stereoisomers.

47. The method according to any one of paragraphs 44-46 wherein the homofarnesol comprises an EE:EZ stereoisomer mixture in the weight ratios selected from the group consisting of: 100:00; 99:01; 98:02; 97:03; 96:04; 95:05; 94:06; 93:07; 92:08; 91:09; 90:10; 89:11; 88:12; 87:13; 86:14; 85:15; 84:16; 83:17; 82:18; 81:19; 80:20; 79:21; 78:22; 77:23; 76:24; 75:25; 74:26; 73:27; 72:28; 71:29 and 70:30.

48. The method of paragraph 47 wherein the homofarnesol comprises an EE:EZ stereoisomer mixture in a weight ratio is selected from the group consisting of: EE:EZ 90:10; EE:EZ 80: 20; EE:EZ 86:14; EE:EZ 70:30; EE:EZ 69:31; and EE:EZ 66:34.

49. The method paragraph 35 or 36 wherein the homofarnesol comprises an EE:EZ stereoisomer mixture in a weight ratio of 80:20.

50. The method of any one of paragraphs 37-49 wherein (−)-Ambrox is produced in admixture with one or more of the by-products (II), (IV) and/or (III).

51. The method of any one of paragraphs 37-50 wherein (−)-Ambrox is isolated from the bioconversion reaction mixture using an organic solvent or a steam extraction/distillation step, or filtration.

52. The method according to paragraph 51 wherein (−)-Ambrox is isolated from the reaction mixture using an organic solvent.

53. The method of paragraph 52 wherein the (−)-Ambrox is selectively crystallized from (−)-Ambrox using an organic solvent.

54. The method of paragraph 52 or 53 wherein the (−)-Ambrox is substantially free of the by-products (II), (IV) and/or (III).

55. (−)-Ambrox obtainable by the method of any one of paragraphs 51-54.

56. The (−)-Ambrox of paragraph 55 in a solid form, preferably in an amorphous or crystalline form.

57. A method for making a product containing (−)-Ambrox comprising incorporating the (−)-Ambrox of paragraph 55 or 56 into the product, preferably a fragrance product, a cosmetic product, a cleaning product, a detergent product or a soap product.

58. A fragrance or cosmetic or a consumer care product comprising the (−)-Ambrox of paragraph 55 or 56.

59. A fragrance or cosmetic or consumer care composition comprising the (−)-Ambrox of paragraph 55 or 56 and one or more additional components.

60. The use of the (−)-Ambrox of paragraph 55 or 56 as part of a fragrance or a cosmetic or a consumer product such as a fabric care, toiletry, beauty care and/or a cleaning product.

61. The use of a SHC/HAC derivative enzyme according to any one of paragraphs 1-21, a nucleotide sequence according to paragraphs 22 or 23, a construct according to any one of paragraphs 24-26 or 30, a vector according to any one of paragraphs 27-30 or a recombinant host cell according to any one of paragraphs 31-34 or a recombinant host cell expressing a WT SHC/HAC for the bioconversion of homofarnesol to (−)-Ambrox wherein the WT SHC/HAC enzyme is used with a solubilizing agent other than Triton X-100 for the bioconversion reaction.

Additional Aspects of the Invention (BJpSHC)

1. A squalene hopene cyclase (SHC)/homofarnesol Ambrox cyclase (HAC) derivative comprising an amino acid sequence having from 1-50 mutations independently selected from substitutions, deletions or insertions relative to SEQ ID No. 4.

2. The SHC/HAC derivative according to paragraph 1 wherein the SHC derivative comprises an amino acid sequence having from 1 to 40 mutations, from 1-30 mutations, from 1-20 mutations, from 1-10 mutations or from 1-6 mutations relative to SEQ ID No. 4.

3. The SHC/HAC derivative according to paragraph 1 or paragraph 2 wherein the SHC/HAC derivative comprises an amino acid sequence having at least 40% identity, at least 50% identity, or at least 60% identity, or at least 70% identity, or at least 80% identity, or at least 90% identity, or at least 95% identity, or at least 96% identity, or at least 97% identity, or at least 98% identity, or at least 99% identity relative to SEQ ID No. 4.

4. The SHC/HAC derivative according to paragraph 3 wherein the SHC variant comprises an amino acid sequence having at least 95% identity to SEQ ID No. 4.

5. A SHC/HAC derivative comprising 1-10 mutations independently selected from substitutions, deletions or insertions relative to SEQ ID No. 4 wherein the one or more mutations other than an SHC active site mutation is/are located in domain 2 of the SHC enzyme (FIGS. 19 and/or 20).

6. The SHC/HAC derivative according to any one of paragraphs 1-5 wherein the one or more mutations relative to SEQ ID No. 4 are selected from Table 4 wherein if only one mutation is selected it is not F628Y.

7. The SHC/HAC derivative of paragraph 6 wherein at least 2, 3, 4, 5, 6, 7, 8, 9 or 10 mutations are selected from Table 4 and/or Table 8.

8. The SHC/HAC derivative of paragraph 2 comprising an amino acid sequence that has up to 6 mutations relative to SEQ ID No. 4 and comprises at least the substitutions F628Y or I140R in combination with at least any one or more of F137L and/or I450T.

9. The SHC/HAC derivative of paragraph 7 comprising an amino acid sequence which has up to 8 amino acid alterations relative to SEQ ID No. 4 and comprises one or more one amino acid alteration in a position selected from the group consisting of positions 88, 104, 141, 144, 241, 459, 607 and 628 relative to SEQ ID No. 4 wherein the SHC/HAC derivative has an increased HAC enzymatic activity relative to SEQ ID No. 4.

10. The SHC/HAC derivative according to paragraph 9 comprising one or more substitutions selected from the group consisting of: A88A, V104V, F141L, Y144R, V241V, I459T, M607H and F628Y relative to SEQ ID No. 4.

11. The SHC/HAC derivative according to paragraph 10 comprising F628Y.

12. The SHC/HAC derivative according to paragraph 10 comprising F141L.

13. The SHC/HAC derivative according to paragraph 10 comprising F628Y and F141L.

14. The SHC/HAC derivative according to paragraph 10 comprising Y144R and I459T.

15. The SHC/HAC derivative according to paragraph 14 further comprising V241V.

16. The SHC/HAC derivative according to paragraph 14 further comprising F628Y.

17. The SHC/HAC derivative according to paragraph 14 further comprising F141L.

18. The SHC/HAC derivative according to paragraph 17 further comprising F628Y.

19. The SHC/HAC derivative according to paragraph 11 further comprising M607H.

20. The SHC derivative according to paragraph 10 comprising S129A and V145V and F182L.

21. The SHC/HAC derivative according to any one of the preceding paragraphs having the amino acid sequence selected from the group consisting of SEQ ID No. 113, 115, 117, 119, 121, 123, 125, 127, 129, 131, 133, 135, 137, 139, 141, 143, 145 and/or 147.
22. An isolated nucleotide sequence encoding the SHC derivative according to any one of paragraphs 1-21.
23. The isolated nucleotide sequence according to paragraph 22 wherein the nucleotide sequence is selected from the group consisting of SEQ ID No. 114, 116, 118, 120, 124, 126, 128, 130, 132, 134, 136, 138, 140, 142, 144, 146 and/or 148.
24. A construct comprising the nucleotide sequence of paragraph 22 or paragraph 23.
25. A construct according to paragraph 24 comprising a promoter functionally linked to the nucleotide sequence of paragraph 22 or 23.
26. The construct of paragraph 25 wherein the promoter is an inducible or a constitutive promoter.
27. A vector comprising the construct according to any one of paragraphs 24-26.
28. The vector of paragraph 27 wherein the vector is a plasmid.
29. The vector according to paragraph 28 capable of directing expression in host cells selected from prokaryotic, yeast, plant and insect host cells.
30. The construct of any one of paragraphs 24-26 or the vector according to any one of paragraphs 27-29 wherein the construct or the vector is capable of integration into the genome of a host cell selected from prokaryotic, yeast, plant and insect host cells.
31. A recombinant host cell comprising a nucleotide sequence according to paragraph 22 or 23 or a construct according to any one of paragraphs 24-26 or 30 or a vector according to any one of paragraphs 27-30.
32. The recombinant host cell according to paragraph 31 wherein the host cell is selected from the group of prokaryotic host cells consisting of the bacteria of the genus *Escherichia*, *Streptomyces*, *Bacillus*, *Pseudomonas*, *Lactobacillus* and *Lactococcus*.
33. The recombinant host cell of paragraph 32 wherein the host cell is an *E. coli* host cell.
34. The recombinant host cell of paragraph 33 wherein the host cell overexpresses the gene encoding the SHC/HAC derivative.
35. A method of preparing the SHC/HAC derivative according to any one of paragraphs 1-21 comprising the steps of: (a) culturing one or more recombinant host cells according to any one of paragraphs 31-34 under conditions which permit production of the SHC/HAC derivative enzyme.
36. The method of paragraph 35 wherein the cell culture takes place under conditions suitable for biocatalyst production.
37. A method of preparing (−)-Ambrox comprising converting homofarnesol to (−)-Ambrox using a recombinant host cell according to any one of paragraphs 31-34 or by using a recombinant host cell comprising SEQ ID No. 168 encoding a WT SHC/HAC wherein if a WT SHC/HAC is used, the bioconversion of homofarnesol to (−)-Ambrox is carried out with a solubilising agent other than Triton X-100.
38. The method according to paragraph 37 wherein the conversion of homofarnesol to (−)-Ambrox under suitable bioconversion reaction conditions for the WT SHC/HAC or the SHC/HAC derivative enzyme.
39. The method according to paragraph 37 or 38 wherein the conversion of homofarnesol to (−)-Ambrox takes place under suitable pH, temperature, solubilising agent concentrations for the WT SHC/HAC or the SHC/HAC derivative enzyme.
40. The method according to paragraph 39 wherein the conversion of homofarnesol to (−)-Ambrox takes place at a temperature in the range of from 30° C. to 60° C., at a pH in the range of about 4-8 and in the presence of a solubilising agent other than Triton X-100 for the WT SHC/HAC enzyme.
41. The method according to any one of paragraphs 37-40 wherein the conversion of homofarnesol to (−)-Ambrox takes place using one or more of the reaction conditions for the WT SHC/HAC or SHC/HAC derivative enzyme as set out in Table 24 or Table 24a.
42. The method of any one of paragraphs 37-41 wherein the weight ratio of biocatalyst to homofarnesol is in the range of from about 0.5:1 to 2:1, preferably about 1:1 or 0.5:1.
43. The method according to any one of paragraphs 37-42 wherein the cell growth and bioconversion reaction steps are carried out in the same reaction vessel.
44. The method according to any one of paragraphs 27-31 wherein the homofarnesol substrate comprises one or more homofarnesol stereoisomers.
45. The method of paragraph 44 wherein the homofarnesol substrate comprises two homofarnesol stereoisomers.
46. The method of paragraph 45 wherein the homofarnesol substrate comprises EE:EZ stereoisomers.
47. The method according to any one of paragraphs 44-46 wherein the homofarnesol comprises an EE:EZ stereoisomer mixture in the weight ratios selected from the group consisting of: 100:00; 99:01; 98:02; 97:03; 96:04; 95:05; 94:06; 93:07; 92:08; 91:09; 90:10; 89:11; 88:12; 87:13; 86:14; 85:15; 84:16; 83:17; 82:18; 81:19; 80:20; 79:21; 78:22; 77:23; 76:24; 75:25; 74:26; 73:27; 72:28; 71:29 and 70:30.
48. The method of paragraph 47 wherein the homofarnesol comprises an EE:EZ stereoisomer mixture in a weight ratio is selected from the group consisting of: EE:EZ 90:10; EE:EZ 80:20; EE:EZ 86:14; EE:EZ 70:30; EE:EZ 69:31; and EE:EZ 66:34.
49. The method paragraph 35 or 36 wherein the homofarnesol comprises an EE:EZ stereoisomer mixture in a weight ratio of 80:20.
50. The method of any one of paragraphs 37-49 wherein (−)-Ambrox is produced in admixture with one or more of the by-products (II), (IV) and/or (III).
51. The method of any one of paragraphs 37-50 wherein (−)-Ambrox is isolated from the bioconversion reaction mixture using an organic solvent or a steam extraction/distillation step, or filtration.
52. The method according to paragraph 51 wherein (−)-Ambrox is isolated from the reaction mixture using an organic solvent.
53. The method of paragraph 52 wherein the (−)-Ambrox is selectively crystallized from (−)-Ambrox using an organic solvent.
54. The method of paragraph 52 or 53 wherein the (−)-Ambrox is substantially free of the by-products (II), (IV) and/or (III).
55. (−)-Ambrox obtainable by the method of any one of paragraphs 51-54.
56. The (−)-Ambrox of paragraph 55 in a solid form, preferably in an amorphous or crystalline form.
57. A method for making a product containing (−)-Ambrox comprising incorporating the (−)-Ambrox of paragraph 55 or 56 into the product, preferably a fragrance product, a cosmetic product, a cleaning product, a detergent product or a soap product.

58. A fragrance or cosmetic or a consumer care product comprising the (−)-Ambrox of paragraph 55 or 56.

59. A fragrance or cosmetic or consumer care composition comprising the (−)-Ambrox of paragraph 55 or 56 and one or more additional components.

60. The use of the (−)-Ambrox of paragraph 55 or 56 as part of a fragrance or a cosmetic or a consumer product such as a fabric care, toiletry, beauty care and/or a cleaning product.

61. The use of a SHC/HAC derivative enzyme according to any one of paragraphs 1-21, a nucleotide sequence according to paragraphs 22 or 23, a construct according to any one of paragraphs 24-26 or 30, a vector according to any one of paragraphs 27-30 or a recombinant host cell according to any one of paragraphs 31-34 or a recombinant host cell expressing a WT SHC/HAC for the bioconversion of homofarnesol to (−)-Ambrox wherein the WT SHC/HAC enzyme is used with a solubilizing agent other than Triton X-100 for the bioconversion reaction.

In another aspect, there is provided an SHC crystal model structure (CMS) based on the structural coordinates of SHC with an amino acid sequence of SHC or derivative described herein. The SHC CMS comprises a squalene/homofarnesol binding pocket domain (SHBD) that comprises a squalene/homofarnesol binding pocket (SHBP) and a squalene/homofarnesol substrate bound to the SBD (eg. see FIGS. 19 and 20). This SHC crystal model structure (CMS) facilitates in-silico testing of potential SHC/HAC derivative enzyme candidates.

Thus, in still other embodiments, the present disclosure provides a method of screening for an enzyme (eg. a SHC/HAC derivative) capable of binding to a SHBD wherein the method comprises the use of the SHC/HAC CMS. In another aspect, the present disclosure provides a method for screening for an enzyme (eg. a reference SHC or a SHC/HAC derivative) capable of binding to the SHBP, and the method comprises contacting the SHBP with a test compound (eg. a SHC derivative), and determining if said test compound binds to said SHBP. In some embodiments, the method is to screen for a test compound (eg. a modulator) useful in modulating the activity of an SHC derivative enzyme.

In another aspect, the present disclosure provides a method for predicting, simulating or modelling the molecular characteristics and/or molecular interactions of a reference SHC and/or a SHC/HAC derivative with a squalene/homofarnesol binding domain (SHBD) comprising the use of a computer model, said computer model comprising, using or depicting the structural coordinates of a squalene/homofarnesol binding domain as defined above to provide an image of said ligand binding domain and to optionally display said image.

Throughout this specification and the claims which follow, unless the context requires otherwise, the word "comprise", and variations such as "comprises" and "comprising", will be understood to imply the inclusion of a stated integer or step or group of integers or steps but not the exclusion of any other integer or step or group of integer or step. The term "comprising" also means "including" as well as "consisting" eg. a composition "comprising" X may consist exclusively of X or may include something additional eg. X+Y. It must be noted also that, as used in this specification and the appended claims, the singular forms "a", "an" and "the" include plural referents unless the content clearly dictates otherwise. By way of example, a reference to "a gene" or "an enzyme" is a reference to "one or more genes" or "one or more enzymes".

It is to be understood that this disclosure is not limited to the particular methodology, protocols and reagents described herein as these may vary. It is also to be understood that the terminology used herein is for the purpose of describing particular embodiments only, and is not intended to limit the scope of the present disclosure which will be limited only by the appended claims. Unless defined otherwise, all technical and scientific terms used herein have the same meanings as commonly understood by the person skilled in the art. In accordance with the present disclosure there may be conventional molecular biology, microbiology, and recombinant DNA techniques employed which are within the skill of the art.

This disclosure is not limited in its application to the details of construction and the arrangement of components set forth in the following description or illustrated in the drawings. The disclosure is capable of other embodiments and of being practiced or of being carried out in various ways. Also, the phraseology and terminology used herein is for the purpose of description and should not be regarded as limiting.

Preferably, the terms used herein are defined as described in "A multilingual glossary of biotechnological terms: (IUPAC Recommendations)", Leuenberger, H. G. W, Nagel, B. and Kolbl, H. eds. (1995), Helvetica Chimica Acta, CH-4010 Basel, Switzerland).

Several documents are cited throughout the text of this specification. Each of the documents cited herein (including all patents, patent applications, scientific publications, manufacturer's specifications, instructions, GenBank Accession Number sequence submissions etc.), whether supra or infra, is hereby incorporated by reference in its entirety.

The examples described herein are illustrative of the present disclosure and are not intended to be limitations thereon. Different embodiments of the present disclosure have been described according to the present disclosure. Many modifications and variations may be made to the techniques described and illustrated herein without departing from the spirit and scope of the disclosure. Accordingly, it should be understood that the examples are illustrative only and are not limiting upon the scope of the disclosure.

TABLE 10 provides the accession number for AacSHC

| SHC source strain (SHC name) | Reference | Accession No. |
|---|---|---|
| *Alicyclobacillus acidocaldarius* (WT AacSHC) | JP2009-060799 (Kao) Neumann et al Biol Chem (1986) 367; 723-729 | NBRC15652 |

TABLE 11 provides accession number for ZmoSHC

| SHC source strain (SHC name) | Reference | Strain and Accession No. | SEQ ID No. according to WO 2010139719 US2012/0135477 |
|---|---|---|---|
| *Zymomonas mobilis* | WO2010139719 US2012/0135477 | ATCC31821 PF62207_2 | SEQ ID No. 1 SEQ ID No. 2 |

TABLE 11-continued provides accession number for ZmoSHC

| SHC source strain (SHC name) | Reference | Strain and Accession No. | SEQ ID No. according to WO 2010139719 US2012/0135477 |
|---|---|---|---|
| (WT ZmoSHC) | Reipen et al (1995) Microbiology 141: 155-161. | Genpept Accession No AAV90172 EMBL/Genbank Accession No. for X80766 | |

TABLE 12 shows sources of other SHC enzymes from WO2010139719

| SHC source strain (SHC name) | Reference | Accession No. | SEQ ID No. according to WO 2010139719 US2012/0135477 |
|---|---|---|---|
| Bradryhizobium japonicum (WT BjpSHC) | WO2010139719 US2012/0135477 | PF62207_5 | SEQ ID No. 5 |
| Burkholderia ambifaria | WO2010139719 US2012/0135477 | | SEQ ID No. 6 |
| Burkholderia ambifaria | WO2010139719 US2012/0135477 | | SEQ ID No. 7 |
| Bacillus anthracis | WO2010139719 US2012/0135477 | | SEQ ID No. 8 |
| Frankia alni | WO2010139719 US2012/0135477 | | SEQ ID No. 9 |
| Rhodopseudomonas palent | WO2010139719 US2012/0135477 | | SEQ ID No. 10 |

TABLE 13

WT AacSHC amino acid and nucleotide SEQ ID No.

| Amino acid SEQ ID No. | Strain | Nucleotide SEQ ID No. |
|---|---|---|
| SEQ ID No 1 | WT AacSHC Alicyclobacillus acidocaldarius AB007002.1 | 169 |
| SEQ ID No 1 | (GI: 218288697) Alicyclobacillus acidocaldarius ZP_03492960.1 | 165 |

TABLE 14

AacSHC Derivative amino acid and nucleotide SEQ ID No.

| Amino acid SEQ ID No. | Mutation (s) | SHC Derivative name | Nucleotide SEQ ID No. |
|---|---|---|---|
| SEQ ID No. 5 | T77A | | 6 |
| SEQ ID No. 7 | I92V | | 8 |
| SEQ ID No. 9 | F129L | | 10 |
| SEQ ID No. 11 | M132R | | 12 |
| SEQ ID No. 13 | A224V | | 14 |
| SEQ ID No. 15 | I432T | | 16 |
| SEQ ID No. 17 | Q579H | | 18 |
| SEQ ID No. 19 | F601Y | | 20 |
| SEQ ID No. 171 | F605W | | 170 |
| SEQ ID No. 21 | M132R + A224V + I432T | 215G2 | 22 |
| SEQ ID No. 23 | M132R + I432T | SHC26 | 24 |
| SEQ ID No. 25 | F601Y | SHC3 | 26 |
| SEQ ID No. 27 | T77A + I92V + F129L | 111C8 | 28 |
| SEQ ID No. 29 | Q579H + F601Y | 101A10 | 30 |
| SEQ ID No. 31 | F129L | SHC10 | 32 |
| SEQ ID No. 33 | F129L + F601Y | SHC30 | 34 |
| SEQ ID No. 35 | F129L + M132R + I432T | SHC31 | 36 |
| SEQ ID No. 37 | M132R + I432T + F601Y | SHC32 | 38 |
| SEQ ID No. 39 | F129L + M132R + I432T + F601Y | SHC33 | 40 |

TABLE 15

WT ZmoSHC1 and ZmoSHC1 Derivative Amino acid and nucleotide SEQ ID No.

| Amino acid SEQ ID No. | Strain/mutation(s) | SHC Derivative name | Nucleotide SEQ ID No. |
|---|---|---|---|
| SEQ ID No. 2 | WT ZmoSHC1 ZmoSHC1 (GI: 56552444) ATCC31821] | Reference ZmoSHC1 sequence SEQ ID No. 2 in WO 2010/139719 | 166 |
| SEQ ID No. 41 | S129A | | 42 |
| SEQ ID No. 43 | V145V | | 44 |
| SEQ ID No. 45 | F182L | | 46 |
| SEQ ID No. 47 | Y185R | | 48 |
| SEQ ID No. 49 | G282V | | 50 |
| SEQ ID No. 51 | I498T | | 52 |
| SEQ ID No. 53 | H646H | | 54 |
| SEQ ID No. 55 | F668Y | | 56 |
| SEQ ID No. 57 | Y185R + G282V + I498T | 215G2 ZM1 | 58 |
| SEQ ID No. 59 | Y185R + I498T | SHC26 ZM1 | 60 |
| SEQ ID No. 61 | F668Y | SHC3 ZM1 | 62 |
| SEQ ID No. 63 | S129A + V145V + F182L | 111C8 ZM1 | 64 |
| SEQ ID No. 65 | H646H + F668Y | 101A10 ZM1 | 66 |
| SEQ ID No. 67 | F182L | SHC10 ZM1 | 68 |
| SEQ ID No. 69 | F182L + F668Y | SHC30 ZM1 | 70 |
| SEQ ID No. 71 | F182L + Y185R + I498T | SHC31 ZM1 | 72 |
| SEQ ID No. 73 | Y185R + I498T + F668Y | SHC32 ZM1 | 74 |
| SEQ ID No. 75 | F182L + Y185R + I498T + F668Y | SHC33 ZM1 | 76 |
| SEQ ID No. 173 | F698W | | 172 |

TABLE 16

WT ZmoSHC2 and ZmoSHC2 Derivative amino acid and nucleotide SEQ ID No.

| Amino acid SEQ ID No. | Strain/mutation(s) | SHC Derivative name | Nucleotide SEQ ID No. |
|---|---|---|---|
| SEQ ID No. 3 | WT ZmoSHC2 ZmoSHC2 (GI: 677871) | Reference ZmoSHC1 sequence | 167 |
| SEQ ID No. 77 | G85A | | 78 |
| SEQ ID No. 79 | V100V | | 80 |
| SEQ ID No. 81 | F137L | | 82 |
| SEQ ID No. 83 | I140R | | 84 |
| SEQ ID No. 85 | V233V | | 86 |

TABLE 16-continued

WT ZmoSHC2 and ZmoSHC2 Derivative amino acid and nucleotide SEQ ID No.

| Amino acid SEQ ID No. | Strain/mutation(s) | SHC Derivative name | Nucleotide SEQ ID No. |
|---|---|---|---|
| SEQ ID No. 87 | I450T | | 88 |
| SEQ ID No. 89 | N598H | | 90 |
| SEQ ID No. 91 | F620Y | | 92 |
| SEQ ID No. 93 | I140R + V233V + I450T | 215G2ZM2 | 94 |
| SEQ ID No. 95 | I140R + I450T | SHC26 ZM2 | 96 |
| SEQ ID No. 97 | F620Y | SHC3 ZM2 | 98 |
| SEQ ID No. 99 | G85A + V100V + F137L | 111C8 ZM2 | 100 |
| SEQ ID No. 101 | N598H + F620Y | 101A10 ZM2 | 102 |
| SEQ ID No. 103 | F137L | SHC10 ZM2 | 104 |
| SEQ ID No. 105 | F137L + F620Y | SHC30 ZM2 | 106 |
| SEQ ID No. 107 | F137L + I140R, +I450T | SHC31 ZM2 | 108 |
| SEQ ID No. 109 | I140R + I450T + F620Y | SHC32 ZM2 | 110 |
| SEQ ID No. 111 | F137L + I140R + I450T + F620Y | SHC33 ZM2 | 112 |
| SEQ ID No. 175 | F624W | | 174 |

TABLE 17

WT BjpSHC1 and BjpSHC1 Derivative amino acid and nucleotide SEQ ID No.

| Amino acid SEQ ID No. | Strain/mutation(s) | SHC Derivative name | Nucleotide SEQ ID No. |
|---|---|---|---|
| SEQ ID No. 4 | WT *B. japonicum* SHC (GI:ABQ33590.1) | | 168 |
| SEQ ID No. 113 | A88A | | 114 |
| SEQ ID No. 115 | V104V | | 116 |
| SEQ ID No. 117 | F141L | | 118 |
| SEQ ID No. 119 | Y144R | | 120 |
| SEQ ID No. 121 | V241V | | 122 |
| SEQ ID No. 123 | I459T | | 124 |
| SEQ ID No. 125 | M607H | | 126 |
| SEQ ID No. 127 | F628Y | | 128 |
| SEQ ID No. 129 | Y144R + V241V + I459T | 215G2 Bjp | 130 |
| SEQ ID No. 131 | Y144R + I459T | SHC26 Bjp | 132 |
| SEQ ID No. 133 | F628Y | SHC3 Bjp | 134 |
| SEQ ID No. 135 | A88A + V104V + F141L | 111C8 Bjp | 136 |
| SEQ ID No. 137 | M607H + F628Y | 101A10 Bjp | 138 |
| SEQ ID No. 139 | F141L | SHC10 Bjp | 140 |
| SEQ ID No. 141 | F141L + F628Y | SHC30 Bjp | 142 |
| SEQ ID No. 143 | F141L + Y144R + I459T | SHC31 Bjp | 144 |
| SEQ ID No. 145 | M144R + I459T + F628Y | SHC32 Bjp | 146 |
| SEQ ID No. 147 | F141L + Y144R + I459T + F628Y | SHC33 Bjp | 148 |
| SEQ ID No. 177 | F658W | | 176 |

(*Alicyclobacillus acidocaldarius*), AacSHC

SEQ ID No. 1

MAEQLVEAPAYARTLDRAVEYLLSCQKDEGYWWGPLLSNVTMEAEYVLLCHILDRVDRDRMEKIRRYLLHEQREDG
TWALYPGGPPDLDTTIEAYVALKYIGMSRDEEPMQKALRFIQSQGGIESSRVFTRMWLALVGEYPWEKVPMVPPEI
MFLGKRMPLNIYEFGSWARATVVALSIVMSRQPVFPLPERARVPELYETDVPPRRRGAKGGGGWIFDALDRALHGY
QKLSVHPFRRAAEIRALDWLLERQAGDGSWGGIQPPWFYALIALKILDMTQHPAFIKGWEGLELYGVELDYGGWMF
QASISPVWDTGLAVLALRAAGLPADHDRLVKAGEWLLDRQITVPGDWAVKRPNLKPGGFAFQFDNVYYPDVDDTAV
VVWALNTLRLPDERRRDAMTKGFRWIVGMQSSNGGWGAYDVDNTSDLPNHIPFCDFGEVTDPPSEDVTAHVLECF
GSFGYDDAWKVIRRAVEYLKREQKPDGSWFGRWGVNYLYGTGAVVSALKAVGIDTREPYIQKALDWVEQHQNPDGG
WGEDCRSYEDPAYAGKGASTPSQTAWALMALIAGGRAESEAARRGVQYLVETQRPDGGWDEPYYTGTGFPGDFYLG
YTMYRHVFPTLALGRYKQAIERR (*Zymomonas mobilis*), ZmoSHC1

SEQ ID No. 2

MGIDRMNSLSRLLMKKIFGAEKTSYKPASDTIIGTDTLKRPNRRPEPTAKVDKTIFKTMGNSLNNTLVSACDWLIG
QQKPDGHWVGAVESNASMEAEWCLALWFLGLEDHPLRPRLGNALLEMQREDGSWGVYFGAGNGDINATVEAYAALR
SLGYSADNPVLKKAAAWIAEKGGLKNIRVFTRYWLALIGEWPWEKTPNLPPEIIWFPDNFVFSIYNFAQWARATMV
PIAILSARRPSRPLRPQDRLDELFPEGRARFDYELPKKEGIDLWSQFFRTTDRGLHWVQSNLLKRNSLREAAIRHV
LEWIIRHQDADGGWGGIQPPWVYGLMALHGEGYQLYHPVMAKALSALDDPGWRHDRGESSWIQATNSPVWDTMLAL
MALKDAKAEDRFTPEMDKAADWLLARQVKVKGDWSIKLPDVEPGGWAFEYANDRYPDTDDTAVALIALSSYRDKEE
WQKKGVEDAITRGVNWLIAMQSECGGWGAFDKDNNRSILSKIPFCDFGESIDPPSVDVTAHVLEAFGTLGLSRDMP
VIQKAIDYVRSEQEAEGAWFGRWGVNYIYGTGAVLPALAAIGEDMTQPYITKACDWLVAHQQEDGGWGESCSSYME
IDSIGKGPTTPSQTAWALMGLIAANRPEDYEAIAKGCHYLIDRQEQDGSWKEEEFTGTGFPGYGVGQTIKLDDPAL
SKRLLQGAELSRAFMLRYDFYRQFFPIMALSRAERLIDLNN (*Zymomonas mobilis*), ZmoSHC2
SEQ ID No. 3
MTVSTSSAFHHSPLSDDVEPIIQKATRALLEKQQQDGHWVFELEADATIPAEYILLKHYLGEPEDLEIEAKIGRYL
RRIQGEHGGWSLFYGGDLDLSATVKAYFALKMIGDSPDAPHMLRARNEILARGGAMRANVFTRIQLALFGAMSWEH
VPQMPVELMLMPEWFPVHINKMAYWARTVLVPLLVLQALKPVARNRRGILVDELFVPDVLPTLQESGDPIWRRFFS
ALDKVLHKVEPYWPKNMRAKAIHSCVHFVTERLNGEDGLGAIYPAIANSVMMYDALGYPENHPERAIARRAVEKLM
VLDGTEDQGDKEVYCQPCLSPIWDTALVAHAMLEVGGDEAEKSAISALSWLKPQQILDVKGDWAWRRPDLRPGGWA
FQYRNDYYPDVDDTAVVTMAMDRAAKLSDLHDDFEESKARAMEWTIGMQSDNGGWGAFDANNSYTYLNNIPFADHG
ALLDPPTVDVSARCVSMMAQAGISITDPKMKAAVDYLLKEQEEDGSWFGRWGVNYIYGTWSALCALNVAALPHDHL
AVQKAVAWLKTIQNEDGGWGENCDSYALDYSGYEPMDSTASQTAWALLGLMAVGEANSEAVTKGINWLAQNQDEEG
LWKEDYYSGGGFPRVFYLRYHGYSKYFPLWALARYRNLKKANQPIVHYGM (*Bradyrhizobium japonicum*), BjpSHC
SEQ ID No. 4
MTVTSSASARATRDPGNYQTALQSTVRAAADWLIANQKPDGHWVGRAESNACMEAQWCLALWFMGLEDHPLRKRLG
QSLLDSQRPDGAWQVYFGAPNGDINATVEAYAALRSLGFRDDEPAVRRAREWIEAKGGLRNIRVFTRYWLALIGEW
PWEKTPNIPPEVIWFPLWFPFSIYNFAQWARATLMPIAVLSARRPSRPLPPENRLDALFPHGRKAFDYELPVKAGA
GGWDRFFRGADKVLHKLQNLGNRLNLGLFRPAATSRVLEWMIRHQDFDGAWGGIQPPWIYGLMALYAEGYPLNHPV
LAKGLDALNDPGWRVDVGDATYIQATNSPVWDTILTLLAFDDAGVLGDYPEAVDKAVDWVLQRQVRVPGDWSMKLP
HVKPGGWAFEYANNYYPDTDDTAVALIALAPLRHDPKWKAKGIDEAIQLGVDWLIGMQSQGGGWGAFDKDNNQKIL
TKIPFCDYGEALDPPSVDVTAHIIEAFGKLGISRNHPSMVQALDYIRREQEPSGPWFGRWGVNYVYGTGAVLPALA
AIGEDMTQPYIGRACDWLVAHQQADGGWGESCASYMDVSAVGRGTTTASQTAWALMALLAANRPQDKDAIERGCMW
LVERQSAGTWDEPEFTGTGFPGYGVGQTIKLNDPALSQRLMQGPELSRAFMLRYGMYRHYFPLMALGRALRPQSHS (*Burkholderia ambifaria*)
SEQ ID No. 149
MNDLTEMATLSAGTVPAGLDAAVASATDALLAAQNADGHWVYELEADSTIPAEYVLLVHYLGETPNLELEQKIGRY
LRRVQQADGGWPLFTDGAPNISASVKAYFALKVIGDDENAEHMQRARRAIQAMGGAEMSNVFTRIQLALYGAIPWR
AVPMMPVEIMLLPQWFPFHLSKVSYWARTVIVPLLVLNAKRPIAKNPRGVRIDELFVDPPVNAGLLPRQGHQSPGW
FAFFRVVDHALRAADGLFPNYTRERAIRQAVSFVDERLNGEDGLGAIYPAMANAVMMYDVLGYAEDHPNRAIARKS
IEKLLVVQEDEAYCQPCLSPVWDTSLAAHALLETGDARAEEAVIRGLEWLRPLQILDVRGDWISRRPHVRPGGWAF
QYANPHYPDVDDTAVVAVAMDRVQKLKHNDAFRDSIARAREWVVGMQSSDGGWGAFEPENTQYYLNNIPFSDHGAL
LDPPTADVSGRCLSMLAQLGETPLNSEPARRALDYMLKEQEPDGSWYGRWGMNYVYGTWTALCALNNAAGLTPDDPR
VKRGAQWLLSIQNKDGGWGEDGDSYKLNYRGFEQAPSTASQTAWALLGLMAAGEVNNPAVARGVEYLIAEQKEHGL
WDETRFTATGFPRVFYLRYHGYRKFFPLWALARYRNLKRNNATRVTFGL (*Burkholderia ambifaria*)
SEQ ID No. 151
MIRRMNKSGPSPWSALDAAIARGRDALMRLQQPDGSWCFELESDATITAEYILMMHFMDKIDDARQEKMARYLRAI
QRLDTHGGWDLYVDGDPDVSCSVKAYFALKAAGDSEHAPHMVRARDAILELGGAARSNVFTRILLATFGQVPWRAT
PFMPIEFVLFPKWVPISMYKVAYWARTTMVPLLVLCSLKARARNPRNIAIPELFVTPPDQERQYFPPARGMRRAFL
ALDRVVRHVEPLLPKRLRQRAIRHAQAWCAERMNGEDGLGGIFPPIVYSYQMMDVLGYPDDHPLRRDCENALEKLL
VTRPDGSMYCQPCLSPVWDTAWSTMALEQARGVAVPEAGAPASALDELDARIARAYDWLAERQVNDLRGDWIENAP
ADTQPGGWAFQYANPYYPDIDDSAVVTAMLDRRGRTHRNADGSHPYAARVARALDWMRGLQSRNGGFAAFDADCDR
LYLNAIPFADHGALLDPPTEDVSGRVLLCFGVTKRADDRASLARAIDYVKRTQQPDGSWWGRWGTNYLYGTWSVLA
GLALAGEDPSQPYIARALAWLRARQHADGGWGETNDSYIDPALAGTNAGESTSNCTAWALLAQMAFGDGESESVRR
GIAYLQSVQQDDGFWWHRSHNAPGFPRIFYLKYHGYTAYFPLWALARYRRLAGGVSAAGAHAVPASTGADAALA -continued (*Bacillus anthracis*)

SEQ ID No. 153

MLLYEKAHEEIVRRATALQTMQWQDGTWRFCFEGAPLTDCHMIFLLKLLGRDKEIEPFVERVASLQTNEGTWKLHE

DEVGGNLSATIQSYAALLASKKYTKEDANMKRAENFIQERGGVARAHFMTKFLLAIHGEYEYPSLFHLPTPIMFLQ

NDSPFSIFELSSSARIHLIPMMLCLNKRFRVGKKLLPNLNHIAGGGGEWFREDRSPVFQTLLSDVKQIISYPLSLH

HKGYEEIERFMKERIDENGTLYSYATASFYMIYALLALGHSLQSSMIQKAIAGITSYIWKMERGNHLQNSPSTVWD

TALLSYALQEAQVSKDNKMIQNATAYLLKKQHTKKADWSVHAPALTPGGWGFSDVNTTIPDIDDTTAVLRALARSR

GNKNIDNAWKKGGNWIKGLQNNDGGWGAFEKGVTSKLLAKLPIENASDMITDPSTPDITGRVLEFFGTYAQNELPE

KQIQRAINWLMNVQEENGSWYGKWGICYLYGTWAVMTGLRSLGIPSSNPSLTRAASWLEHIQHEDGGWGESCHSSV

EKRFVTLPFSTPSQTAWALDALISYYDTETPAIRKGVSYLLSNPYVNERYPTGTGLPGAFYIRYHSYAHIYPLLTL

AHYIKKYRK (*Frankia alni*)

SEQ ID No. 155

MPAGVGVLVWLDQRLRAMGRPDLVTTTGGAEIPFVLVAATASTVGVALALRRPRHPVGWLFLALGGVLLLSGGTQG

YAAYGAVARPGRLPAADLVAIYADAGFIPWLVLVALILHLTPTGRPLSARWGRIALATAVAGGLWLLVGLVTTETM

QPPFQSVTNPLLIGGPLGPLLVARRVLGLATGAGVVLAAVSLIVRFRRSVDVERRQLLWVAVAAVPLPVLMAASFA

ASYAGNNTAAGLAAATLIGLLAIGAGLAIGQYHLYDVEEILSRAVTYLLVSGLLAASYATVVIVVGQSLAGRTGRS

QISAVLATLAAVAVTAPAYRKIQEGVDRRFSRRRFETLQVIRRYLRDPDPDVAVEEVLRRALGDPTLAVAYLVDDR

RQWVSADGQPANPGNSFMAAVEVYRRGRPIARVTFDRGRAQPGLVRAAATAATAELDNAGLRAAVALQLVEVRQSR

TRIAAAQFAERRTIERNLHDGAQQRLLALALQLRAVQLGGDEASLRQAISTGIDQLQAAVVELRELANGLHPAVLA

DGGLAAALDDVAARTPVPIKISAPDRRYPPDLEAAAWFIACEAMANAVKHAHPTTIAVDVSAPDGQLIVEVRDDGI

GGAQPSGPGLRGIADRAEAFGGSLTVHTDPGTGTTIRALLHRRSPLSSGRRSVMIEGCVDVVAVRRFRCRSSRGSG

SRRRRSSWRCGGICGSRCRTGMSRSCSRNAASKLIT (*Rhodopseudomonas palent*)

SEQ ID No. 157

MDSILAPRADAPRNIDGALRESVQQAADWLVANQKPDGHWVGRAETNATMEAQWCLALWFLGLEDHPLRVRLGRAL

LDTQRPDGAWHVFYGAPNGDINATVEAYAALRSLGHRDDEEPLRKARDWILSKGGLANIRVFTRYWLALIGEWPWE

KTPNILPEVIWLPTWFPFSIYNFAQWARATLMPIAVLSAHRPSRPLAPQDRLDALFPQGRDSFNYDLPARLGAGVW

DVIFRKIDTILHRLQDWGARRGPHGIMRRGAIDHVLQWIIRHQDYDGSWGGIQPPWIYGLMALHTEGYAMTHPVMA

KALDALNEPGWRIDIGDATFIQATNSPVWDTMLSLLAFDDAGLGERYPEQVERAVRWVLKRQVLVPGDWSVKLPDV

KPGGWAFEYANNFYPDTDDTSVALMALAPFRHDPKWQAEGIEDAIQRGIDWLVAMQCKEGGWGAFDKDNDKKILAK

IPFCDFGEALDPPSADVTAHIIEAFAKVGLDRNHPSIVRALDYLKREQEPEGPWFGRWGVNYVYGTGAVLPALAAI

GEDMRQPYIARACDWLIARQQANGGWGESCVSYMDAKQAGEGTATASQTAWALMALIAADRPQDRDAIERGCLYLT

ETQRDGTWQEVHYTGTGFPGYGVGQTIKLNDPLLSKRLMQGPELSRSFMLRYDLYRHYFPMMAIGRVLRQRGDRSG

H (*Streptomyces coelicolor*)

SEQ ID No. 159

MTATTDGSTGASLRPLAASASDTDITIPAAAAGVPEAAARATRRATDFLLAKQDAEGWWKGDLETNVTMDAEDLLL

RQFLGIQDEETTRAAALFIRGEQREDGTWATFYGGPGELSTTIEAYVALRLAGDSPEAPHMARAAEWIRSRGGIAS

ARVFTRIWLALFGWWKWDDLPELPPELTYFPTWVPLNIYDFGCWARQTIVPLTIVSAKRPVRPAPFPLDELHTDPA

RPNPPRPLAPVASWDGAFQRIDKALHAYRKVAPRRLRRAAMNSAARWIIERQENDGCWGGIQPPAVYSVIALYLLG

YDLEHPVMRAGLESLDRFAVWREDGARMIEACQSPVWDTCLATIALADAGVPEDHPQLVKASDWMLGEQIVRPGDW

SVKRPGPPGGWAFEFHNDNYPDIDDTAEVVLALRRVRHHDPERVEKAIGRGVRWNLGMQSKNGAWGAFDVDNTSAF

PNRLPFCDFGEVIDPPSADVTAHVVEMLAVEGLAHDPRTRRGIQWLLDAQETDGSWFGRWGVNYVYGTGSVIPALT

-continued

AAGLPTSHPAIRRAVRWLESVQNEDGGWGEDLRSYRYVREWSGRGASTASQTGWALMALLAAGERDSKAVERGVAW

LAATQREDGSWDEPYFTGTGFPWDFSINYNLYRQVFPLTALGRYVHGEPFAKKPRAADAPAEAAPAEVKGS

SEQ ID No. 169

ATGGCTGAGCAGTTGGTGGAAGCGCCGGCCTACGCGCGGACGCTGGATCGCGCGGTGGAGTATCTCCTCTCCTGCC

AAAAGGACGAAGGCTACTGGTGGGGGCCGCTTCTGAGCAACGTCACGATGGAAGCGGAGTACGTCCTCTTGTGCCA

CATTCTCGATCGCGTCGATCGGGATCGCATGGAGAAGATCCGGCGGTACCTGTTGCACGAGCAGCGCGAGGACGGC

ACGTGGGCCCTGTACCCGGGTGGGCCGCCGGACCTCGACACGACCATCGAGGCGTACGTCGCGCTCAAGTATATCG

GCATGTCGCGCGACGAGGAGCCGATGCAGAAGGCGCTCCGGTTCATTCAGAGCCAGGGCGGGATCGAGTCGTCGCG

CGTGTTCACGCGGATGTGGCTGGCGCTGGTGGGAGAATATCCGTGGGAGAAGGTGCCCATGGTCCCGCCGGAGATC

ATGTTCCTCGGCAAGCGCATGCCGCTCAACATCTACGAGTTTGGCTCGTGGGCTCGGGCGACCGTCGTGGCGCTCT

CGATTGTGATGAGCCGCCAGCCGGTGTTCCCGCTGCCCGAGCGGGCGCGCGTGCCCGAGCTGTACGAGACCGACGT

GCCTCCGCGCCGGCGCGGTGCCAAGGGAGGGGGTGGGTGGATCTTCGACGCGCTCGACCGGGCGCTGCACGGGTAT

CAGAAGCTGTCGGTGCACCCGTTCCGCCGCGCGGCCGAGATCCGCGCCTTGGACTGGTTGCTCGAGCGCCAGGCCG

GAGACGGCAGCTGGGGCGGGATTCAGCCGCCTTGGTTTTACGCGCTCATCGCGCTCAAGATTCTCGACATGACGCA

GCATCCGGCGTTCATCAAGGGCTGGGAAGGTCTAGAGCTGTACGGCGTGGAGCTGGATTACGGAGGATGGATGTTT

CAGGCTTCCATCTCGCCGGTGTGGGACACGGGCCTCGCCGTGCTCGCGCTGCGCGCTGCGGGGCTTCCGGCCGATC

ACGACCGCTTGGTCAAGGCGGGCGAGTGGCTGTTGGACCGGCAGATCACGGTTCCGGGCGACTGGGCGGTGAAGCG

CCCGAACCTCAAGCCGGGCGGGTTCGCGTTCCAGTTCGACAACGTGTACTACCCGGACGTGGACGACACGGCCGTC

GTGGTGGGCGCTCAACACCCTGCGCTTGCCGGACGAGCGCCGCAGGCGGGACGCCATGACGAAGGGATTCCGCT

GGATTGTCGGCATGCAGAGCTCGAACGGCGGTTGGGGCGCCTACGACGTCGACAACACGAGCGATCTCCCGAACCA

CATCCCGTTCTGCGACTTCGGCGAAGTGACCGATCCGCCGTCAGAGGACGTCACCGCCCACGTGCTCGAGTGTTTC

GGCAGCTTCGGGTACGATGACGCCTGGAAGGTCATCCGGCGCGCGGTGGAATATCTCAAGCGGGAGCAGAAGCCGG

ACGGCAGCTGGTTCGGTCGTTGGGGCGTCAATTACCTCTACGGCACGGGCGCGGTGGTGTCGGCGCTGAAGGCGGT

CGGGATCGACACGCGCGAGCCGTACATTCAAAAGGCGCTCGACTGGGTCGAGCAGCATCAGAACCCGGACGGCGGC

TGGGGCGAGGACTGCCGCTCGTACGAGGATCCGGCGTACGCGGGTAAGGGCGCGAGCACCCCGTCGCAGACGGCCT

GGGCGCTGATGGCGCTCATCGCGGGCGGCAGGGCGGAGTCCGAGGCCGCGCGCCGCGGCGTGCAATACCTCGTGGA

GACGCAGCGCCCGGACGGCGGCTGGGATGAGCCGTACTACACCGGCACGGGCTTCCCAGGGGATTTCTACCTCGGC

TACACCATGTACCGCCACGTGTTTCCGACGCTCGCGCTCGGCCGCTACAAGCAAGCCATCGAGCGCAGGTGA

Variant 101A10

(SEQ ID No. 30)

ATGGCTGAGCAGTTGGTGGAAGCACCGGCCTACGCGCGGACGCTGGATCGCGCGGTGGAGTATCTCCTCTCCTGCC

AAAAGGACGAAGGCTACTGGTGGGGGCCGCTTCTGAGCAACGTCACGATGGAAGCGGAGTACGTCCTCTTGTGCCA

CATTCTCGATCGCGTCGATCGGGATCGCATGGAGAAGATCCGGCGGTACCTGTTGCACGAGCAGCGCGAGGACGGC

ACGTGGGCCCTGTACCCGGGTGGGCCGCCGGACCTCGACACGACCATCGAGGCGTACGTCGCGCTCAAGTATATCG

GCATGTCGCGCGACGAGGAGCCGATGCAGAAGGCGCTCCGGTTCATTCAGAGCCAGGGCGGGATCGAGTCGTCGCG

CGTGTTCACGCGGATGTGGCTGGCGCTGGTGGGAGAATATCCGTGGGAGAAGGTGCCCATGGTCCCGCCGGAGATC

ATGTTCCTCGGCAAGCGCATGCCGCTCAACATCTACGAGTTTGGCTCGTGGGCTCGGGCGACCGTCGTGGCGCTCT

CGATTGTGATGAGCCGCCAGCCGGTGTTCCCGCTGCCCGAGCGGGCGCGCGTGCCCGAGCTGTACGAGACCGACGT

GCCTCCGCGCCGGCGCGGTGCCAAGGGAGGGGGTGGGTGGATCTTCGACGCGCTCGACCGGGCGCTGCACGGGTAT

CAGAAGCTGTCGGTGCACCCGTTCCGCCGCGCGGCCGAGATCCGCGCCTTGGACTGGTTGCTCGAGCGCCAGGCCG

GAGACGGCAGCTGGGGCGGGATTCAGCCGCCTTGGTTTTACGCGCTCATCGCGCTCAAGATTCTCGACATGACGCA

GCATCCGGCGTTCATCAAGGGCTGGGAAGGTCTAGAGCTGTACGGCGTGGAGCTGGATTACGGAGGATGGATGTTT

-continued

CAGGCTTCCATCTCGCCGGTGTGGGACACGGGCCTCGCCGTGCTCGCGCTGCGCGCTGCGGGGCTTCCGGCCGATC

ACGACCGCTTGGTCAAGGCGGGCGAGTGGCTGTTGGACCGGCAGATCACGGTTCCGGGCGACTGGGCGGTGAAGCG

CCCGAACCTCAAGCCGGGCGGGTTCGCGTTCCAGTTCGACAACGTGTACTACCCGGACGTGGACGACACGGCCGTC

GTGGTGTGGGCGCTCAACACCCTGCGCTTGCCGGACGAGCGCCGCAGGCGGGACGCCATGACGAAGGGATTCCGCT

GGATTGTCGGCATGCAGAGCTCGAACGGCGGTTGGGGCGCCTACGACGTCGACAACACGAGCGATCTCCCGAACCA

CATCCCGTTCTGCGACTTCGGCGAAGTGACCGATCCGCCGTCAGAGGACGTCACCGCCCACGTGCTCGAGTGTTTC

GGCAGCTTCGGGTACGATGACGCCTGGAAGGTCATCCGGCGCGCGGTGGAATATCTCAAGCGGGAGCAGAAGCCGG

ACGGCAGCTGGTTCGGTCGTTGGGGCGTCAATTACCTCTACGGCACGGGCGCGGTGGTGTCGGCGCTGAAGGCGGT

CGGGATCGACACGCGCGAGCCGTACATTCAAAAGGCGCTCGACTGGGTCGAGCAGCATCAGAACCCGGACGGCGGC

TGGGGCGAGGACTGCCGCTCGTACGAGGATCCGGCGTACGCGGGTAAGGGCGCGAGCACCCCGTCGCAGACGGCCT

GGGCGCTGATGGCGCTCATCGCGGGCGGCAGGGCGGAGTCCGAGGCCGCGCGCCGCGGCGTGCATTACCTCGTGGA

GACGCAGCGCCCGGACGGCGGCTGGGATGAGCCGTACTACACCGGCACGGGCTACCCAGGGGATTTCTACCTCGGC

TACACCATGTACCGCCACGTGTTTCCGACGCTCGCGCTCGGCCGCTACAAGCAAGCCATCGAGCGCAGGTGA

Variant 101A10

(SEQ ID No. 29)

MAEQLVEAPAYARTLDRAVEYLLSCQKDEGYWWGPLLSNVTMEAEYVLLCHILDRVDRDRMEKIRRYLLHEQREDG

TWALYPGGPPDLDTTIEAYVALKYIGMSRDEEPMQKALRFIQSQGGIESSRVFTRMWLALVGEYPWEKVPMVPPEI

MFLGKRMPLNIYEFGSWARATVVALSIVMSRQPVFPLPERARVPELYETDVPPRRRGAKGGGGWIFDALDRALHGY

QKLSVHPFRRAAEIRALDWLLERQAGDGSWGGIQPPWFYALIALKILDMTQHPAFIKGWEGLELYGVELDYGGWMF

QASISPVWDTGLAVLALRAAGLPADHDRLVKAGEWLLDRQITVPGDWAVKRPNLKPGGFAFQFDNVYYPDVDDTAV

VVWALNTLRLPDERRRRDAMTKGFRWIVGMQSSNGGWGAYDVDNTSDLPNHIPFCDFGEVTDPPSEDVTAHVLECF

GSFGYDDAWKVIRRAVEYLKREQKPDGSWFGRWGVNYLYGTGAVVSALKAVGIDTREPYIQKALDWVEQHQNPDGG

WGEDCRSYEDPAYAGKGASTPSQTAWALMALIAGGRAESEAARRGVHYLVETQRPDGGWDEPYYTGTGYPGDFYLG

YTMYRHVFPTLALGRYKQAIERR

Variant 111C8

((SEQ ID No. 28)

ATGGCTGAGCAGTTGGTGGAAGCGCCGGCCTACGCGCGGACGCTGGATCGCGCGGTGGAGTATCTCCTCTCCTGCC

AAAAGGACGAAGGCTACTGGTGGGGGCCGCTTCTGAGCAACGTCACGATGGAAGCGGAGTACGTCCTCTTGTGCCA

CATTCTCGATCGCGTCGATCGGGATCGCATGGAGAAGATCCGGCGGTACCTGTTGCACGAGCAGCGCGAGGACGGC

GCGTGGGCCCTGTACCCGGGTGGGCCGCCGGACCTCGACACGACCGTCGAGGCGTACGTCGCGCTCAAGTATATCG

GCATGTCGCGCGACGAGGAGCCGATGCAGAAGGCGCTCCGGTTCATTCAGAGCCAGGGCGGGATCGAGTCGTCGCG

CGTGCTCACGCGGATGTGGCTGGCGCTGGTGGGAGAATATCCGTGGGAGAAGGTGCCCATGGTCCCGCCGGAGATC

ATGTTCCTCGGCAAGCGCATGCCGCTCAACATCTACGAGTTTGGCTCGTGGGCTCGGGCGACCGTCGTGGCGCTCT

CGATTGTGATGAGCCGCCAGCCGGTGTTCCCGCTGCCCGAGCGGGCGCGCGTGCCCGAGCTGTACGAGACCGACGT

GCCTCCGCGCCGGCGCGGTGCCAAGGGAGGGGGTGGGTGGATCTTCGACGCGCTCGACCGGGCGCTGCACGGGTAT

CAGAAGCTGTCGGTGCACCCGTTCCGCCGCGCGGCCGAGATCCGCGCCTTGGACTGGTTGCTCGAGCGCCAGGCCG

GAGACGGCAGCTGGGGCGGGATTCAGCCGCCTTGGTTTTACGCGCTCATCGCGCTCAAGATTCTCGACATGACGCA

GCATCCGGCCGTTCATCAAGGGCTGGGAAGGTCTAGAGCTGTACGGCGTGGAGCTGGATTACGGAGGATGGATGTTT

CAGGCTTCCATCTCGCCGGTGTGGGACACGGGCCTCGCCGTGCTCGCGCTGCGCGCTGCGGGGCTTCCGGCCGATC

ACGACCGCTTGGTCAAGGCGGGCGAGTGGCTGTTGGACCGGCAGATCACGGTTCCGGGCGACTGGGCGGTGAAGCG

CCCGAACCTCAAGCCGGGCGGGTTCGCGTTCCAGTTCGACAACGTGTACTACCCGGACGTGGACGACACGGCCGTC

GTGGTGTGGGCGCTCAACACCCTGCGCTTGCCGGACGAGCGCCGCAGGCGGGACGCCATGACGAAGGGATTCCGCT

GGATTGTCGGCATGCAGAGCTCGAACGGCGGTTGGGGCGCCTACGACGTCGACAACACGAGCGATCTCCCGAACCA

-continued

```
CATCCCGTTCTGCGACTTCGGCGAAGTGACCGATCCGCCGTCAGAGGACGTCACCGCCCACGTGCTCGAGTGTTTC

GGCAGCTTCGGGTACGATGACGCCTGGAAGGTCATCCGGCGCGCGGTGGAATATCTCAAGCGGGAGCAGAAGCCGG

ACGGCAGCTGGTTCGGTCGTTGGGGCGTCAATTACCTCTACGGCACGGGCGCGGTGGTGTCGGCGCTGAAGGCGGT

CGGGATCGACACGCGCGAGCCGTACATTCAAAAGGCGCTCGACTGGGTCGAGCAGCATCAGAACCCGGACGGCGGC

TGGGGCGAGGACTGCCGCTCGTACGAGGATCCGGCGTACGCGGGTAAGGGCGCGAGCACCCCGTCGCAGACGGCCT

GGGCGCTGATGGCGCTCATCGCGGGCGGCAGGGCGGAGTCCGAGGCCGCGCGCCGCGGCGTGCAATACCTCGTGGA

GACGCAGCGCCCGGACGGCGGCTGGGATGAGCCGTACTACACCGGCACGGGCTTCCCAGGGGATTTCTACCTCGGC

TACACCATGTACCGCCACGTGTTTCCGACGCTCGCGCTCGGCCGCTACAAGCAAGCCATCGAGCGCAGGTGA
```

Variant 111C8

(SEQ ID No. 27)

```
MAEQLVEAPAYARTLDRAVEYLLSCQKDEGYWWGPLLSNVTMEAEYVLLCHILDRVDRDRMEKIRRYLLHEQREDG
AWALYPGGPPDLDTTVEAYVALKYIGMSRDEEPMQKALRFIQSQGGIESSRVLTRMWLALVGEYPWEKVPMVPPEI
MFLGKRMPLNIYEFGSWARATVVALSIVMSRQPVFPLPERARVPELYETDVPPRRRGAKGGGGWIFDALDRALHGY
QKLSVHPFRRAAEIRALDWLLERQAGDGSWGGIQPPWFYALIALKILDMTQHPAFIKGWEGLELYGVELDYGGWMF
QASISPVWDTGLAVLALRAAGLPADHDRLVKAGEWLLDRQITVPGDWAVKRPNLKPGGFAFQFDNVYYPDVDDTAV
VVWALNTLRLPDERRRRDAMTKGFRWIVGMQSSNGGWGAYDVDNTSDLPNHIPFCDFGEVTDPPSEDVTAHVLECF
GSFGYDDAWKVIRRAVEYLKREQKPDGSWFGRWGVNYLYGTGAVVSALKAVGIDTREPYIQKALDWVEQHQNPDGG
WGEDCRSYEDPAYAGKGASTPSQTAWALMALIAGGRAESEAARRGVQYLVETQRPDGGWDEPYYTGTGFPGDFYLG
YTMYRHVFPTLALGRYKQAIERR
```

Variant 511C215G2

(SEQ ID No. 22)

```
ATGGCTGAGCAGTTGGTGGAAGCTCCGGCCTACGCGCGGACGCTGGATCGCGCGGTGGAGTATCTCCTCTCCTGCC

AAAAGGACGAAGGCTACTGGTGGGGCCGCTTCTGAGCAACGTCACGATGGAAGCGGAGTACGTCCTCTTGTGCCA

CATTCTCGATCGCGTCGATCGGGATCGCATGGAGAAGATCCGGCGGTACCTGTTGCACGAGCAGCGCGAGGACGGC

ACGTGGGCCCTGTACCCGGGTGGGCCGCCGGACCTCGACACGACCATCGAGGCGTACGTCGCGCTCAAGTATATCG

GCATGTCGCGCGACGAGGAGCCGATGCAGAAGGCGCTCCGGTTCATTCAGAGCCAGGGCGGGATCGAGTCGTCGCG

CGTGTTCACGCGGAGGTGGCTGGCGCTGGTGGGAGAATATCCGTGGGAGAAGGTGCCAATGGTCCCGCCGGAGATC

ATGTTCCTCGGCAAGCGCATGCCGCTCAACATCTACGAGTTTGGCTCGTGGGCTCGGGCGACCGTCGTGGCGCTCT

CGATTGTGATGAGCCGCCAGCCGGTGTTCCCGCTGCCCGAGCGGGCGCGCGTGCCCGAGCTGTACGAGACCGACGT

GCCTCCGCGCCGGCGCGGTGCCAAGGGAGGGGTGGGTGGATCTTCGACGCGCTCGACCGGGTGCTGCACGGGTAT

CAGAAGCTGTCGGTGCACCCGTTCCGCCGCGCGGCCGAGATCCGCGCCTTGGACTGGTTGCTCGAGCGCCAGGCCG

GAGACGGCAGCTGGGGCGGGATTCAGCCGCCTTGGTTTTACGCGCTCATCGCGCTCAAGATTCTCGACATGACGCA

GCATCCGGCGTTCATCAAGGGCTGGGAAGGTCTAGAGCTGTACGGCGTGGAGCTGGATTACGGAGGATGGATGTTT

CAGGCTTCCATCTCGCCGGTGTGGGACACGGGCCTCGCCGTGCTCGCGCTGCGCGCTGCGGGGCTTCCGGCCGATC

ACGACCGCTTGGTCAAGGCGGGCGAGTGGCTGTTGGACCGGCAGATCACGGTTCCGGGCGACTGGGCGGTGAAGCG

CCCGAACCTCAAGCCGGGCGGGTTCGCGTTCCAGTTCGACAACGTGTACTACCCGGACGTGGACGACACGGCCGTC

GTGGTGTGGGCGCTCAACACCCTGCGCTTGCCGGACGAGCGCCGCAGGCGGGACGCCATGACGAAGGGATTCCGCT

GGATTGTCGGCATGCAGAGCTCGAACGGCGGTTGGGGCGCCTACGACGTCGACAACACGAGCGATCTCCCGAACCA

CACCCCGTTCTGCGACTTCGGCGAAGTGACCGATCCGCCGTCAGAGGACGTCACCGCCCACGTGCTCGAGTGTTTC

GGCAGCTTCGGGTACGATGACGCCTGGAAGGTCATCCGGCGCGCGGTGGAATATCTCAAGCGGGAGCAGAAGCCGG

ACGGCAGCTGGTTCGGTCGTTGGGGCGTCAATTACCTCTACGGCACGGGCGCGGTGGTGTCGGCGCTGAAGGCGGT

CGGGATCGACACGCGCGAGCCGTACATTCAAAAGGCGCTCGACTGGGTCGAGCAGCATCAGAACCCGGACGGCGGC
```

```
TGGGGCGAGGACTGCCGCTCGTACGAGGATCCGGCGTACGCGGGTAAGGGCGCGAGCACCCCGTCGCAGACGGCCT

GGGCGCTGATGGCGCTCATCGCGGGCGGCAGGGCGGAGTCCGAGGCCGCGCGCCGCGGCGTGCAATACCTCGTGGA

GACGCAGCGCCCGGACGGCGGCTGGGATGAGCCGTACTACACCGGCACGGGCTTCCCAGGGGATTTCTACCTCGGC

TACACCATGTACCGCCACGTGTTTCCGACGCTCGCGCTCGGCCGCTACAAGCAAGCCATCGAGCGCAGGTGA
```

Variant S11C215G2
                                                                    (SEQ ID No. 21)
```
MAEQLVEAPAYARTLDRAVEYLLSCQKDEGYWWGPLLSNVTMEAEYVLLCHILDRVDRDRMEKIRRYLLHEQREDG

TWALYPGGPPDLDTTIEAYVALKYIGMSRDEEPMQKALRFIQSQGGIESSRVFTRRWLALVGEYPWEKVPMVPPEI

MFLGKRMPLNIYEFGSWARATVVALSIVMSRQPVFPLPERARVPELYETDVPPRRRGAKGGGGWIFDALDRVLHGY

QKLSVHPFRRAAEIRALDWLLERQAGDGSWGGIQPPWFYALIALKILDMTQHPAFIKGWEGLELYGVELDYGGWMF

QASISPVWDTGLAVLALRAAGLPADHDRLVKAGEWLLDRQITVPGDWAVKRPNLKPGGFAFQFDNVYYPDVDDTAV

VVWALNTLRLPDERRRRDAMTKGFRWIVGMQSSNGGWGAYDVDNTSDLPNHTPFCDFGEVTDPPSEDVTAHVLECF

GSFGYDDAWKVIRRAVEYLKREQKPDGSWFGRWGVNYLYGTGAVVSALKAVGIDTREPYIQKALDWVEQHQNPDGG

WGEDCRSYEDPAYAGKGASTPSQTAWALMALIAGGRAESEAARRGVQYLVETQRPDGGWDEPYYTGTGFPGDFYLG

YTMYRHVFPTLALGRYKQAIERR
```

Variant 511C3
                                                                    (SEQ ID No. 26)
```
ATGGCTGAGCAGTTGGTGGAAGCGCCGGCCTACGCGCGGACGCTGGATCGCGCGGTGGAGTATCTCCTCTCCTGCC

AAAAGGACGAAGGCTACTGGTGGGGGCCGCTTCTGAGCAACGTCACGATGGAAGCGGAGTACGTCCTCTTGTGCCA

CATTCTCGATCGCGTCGATCGGGATCGCATGGAGAAGATCCGGCGGTACCTGTTGCACGAGCAGCGCGAGGACGGC

ACGTGGGCCCTGTACCCGGGTGGGCCGCCGGACCTCGACACGACCATCGAGGCGTACGTCGCGCTCAAGTATATCG

GCATGTCGCGCGACGAGGAGCCGATGCAGAAGGCGCTCCGGTTCATTCAGAGCCAGGGCGGGATCGAGTCGTCGCG

CGTGTTCACGCGGATGTGGCTGGCGCTGGTGGGAGAATATCCGTGGGAGAAGGTGCCCATGGTCCCGCCGGAGATC

ATGTTCCTCGGCAAGCGCATGCCGCTCAACATCTACGAGTTTGGCTCGTGGGCTCGGGCGACCGTCGTGGCGCTCT

CGATTGTGATGAGCCGCCAGCCGGTGTTCCCGCTGCCCGAGCGGGCGCGCGTGCCCGAGCTGTACGAGACCGACGT

GCCTCCGCGCCGGCGCGGTGCCAAGGGAGGGGGTGGGTGGATCTTCGACGCGCTCGACCGGGCGCTGCACGGGTAT

CAGAAGCTGTCGGTGCACCCGTTCCGCCGCGCGGCCGAGATCCGCGCCTTGGACTGGTTGCTCGAGCGCCAGGCCG

GAGACGGCAGCTGGGGCGGGATTCAGCCGCCTTGGTTTTACGCGCTCATCGCGCTCAAGATTCTCGACATGACGCA

GCATCCGGCGTTCATCAAGGGCTGGGAAGGTCTAGAGCTGTACGGCGTGGAGCTGGATTACGGAGGATGGATGTTT

CAGGCTTCCATCTCGCCGGTGTGGGACACGGGCCTCGCCGTGCTCGCGCTGCGCGCTGCGGGGCTTCCGGCCGATC

ACGACCGCTTGGTCAAGGCGGGCGAGTGGCTGTTGGACCGGCAGATCACGGTTCCGGGCGACTGGGCGGTGAAGCG

CCCGAACCTCAAGCCGGGCGGGTTCGCGTTCCAGTTCGACAACGTGTACTACCCGGACGTGGACGACACGGCCGTC

GTGGTGTGGGCGCTCAACACCCTGCGCTTGCCGGACGAGCGCCGCAGGCGGGACGCCATGACGAAGGGATTCCGCT

GGATTGTCGGCATGCAGAGCTCGAACGGCGGTTGGGGCGCCTACGACGTCGACAACACGAGCGATCTCCCGAACCA

CATCCCGTTCTGCGACTTCGGCGAAGTGACCGATCCGCCGTCAGAGGACGTCACCGCCCACGTGCTCGAGTGTTTC

GGCAGCTTCGGGTACGATGACGCCTGGAAGGTCATCCGGCGCGCGGTGGAATATCTCAAGCGGGAGCAGAAGCCGG

ACGGCAGCTGGTTCGGTCGTTGGGGCGTCAATTACCTCTACGGCACGGGCGCGGTGGTGTCGGCGCTGAAGGCGGT

CGGGATCGACACGCGCGAGCCGTACATTCAAAAGGCGCTCGACTGGGTCGAGCAGCATCAGAACCCGGACGGCGGC

TGGGGCGAGGACTGCCGCTCGTACGAGGATCCGGCGTACGCGGGTAAGGGCGCGAGCACCCCGTCGCAGACGGCCT

GGGCGCTGATGGCGCTCATCGCGGGCGGCAGGGCGGAGTCCGAGGCCGCGCGCCGCGGCGTGCAATACCTCGTGGA

GACGCAGCGCCCGGACGGCGGCTGGGATGAGCCGTACTACACCGGCACGGGCTACCCAGGGGATTTCTACCTCGGC

TACACCATGTACCGCCACGTGTTTCCGACGCTCGCGCTCGGCCGCTACAAGCAAGCCATCGAGCGCAGGTGA
```

Variant SHC3
(SEQ ID No. 25)
MAEQLVEAPAYARTLDRAVEYLLSCQKDEGYWWGPLLSNVTMEAEYVLLCHILDRVDRDRMEKIRRYLLHEQREDG

TWALYPGGPPDLDTTIEAYVALKYIGMSRDEEPMQKALRFIQSQGGIESSRVFTRMWLALVGEYPWEKVPMVPPEI

MFLGKRMPLNIYEFGSWARATVVALSIVMSRQPVFPLPERARVPELYETDVPPRRRGAKGGGGWIFDALDRALHGY

QKLSVHPFRRAAEIRALDWLLERQAGDGSWGGIQPPWFYALIALKILDMTQHPAFIKGWEGLELYGVELDYGGWMF

QASISPVWDTGLAVLALRAAGLPADHDRLVKAGEWLLDRQITVPGDWAVKRPNLKPGGFAFQFDNVYYPDVDDTAV

VVWALNTLRLPDERRRDAMTKGFRWIVGMQSSNGGWGAYDVDNTSDLPNHIPFCDFGEVTDPPSEDVTAHVLECF

GSFGYDDAWKVIRRAVEYLKREQKPDGSWFGRWGVNYLYGTGAVVSALKAVGIDTREPYIQKALDWVEQHQNPDGG

WGEDCRSYEDPAYAGKGASTPSQTAWALMALIAGGRAESEAARRGVQYLVETQRPDGGWDEPYYTGTGYPGDFYLG

YTMYRHVFPTLALGRYKQAIERR

Variant SHC10
(SEQ ID No. 32)
ATGGCTGAGCAGTTGGTGGAAGCGCCGGCCTACGCGCGGACGCTGGATCGCGCGGTGGAGTATCTCCTCTCCTGCC

AAAAGGACGAAGGCTACTGGTGGGGGCCGCTTCTGAGCAACGTCACGATGGAAGCGGAGTACGTCCTCTTGTGCCA

CATTCTCGATCGCGTCGATCGGGATCGCATGGAAGAAGATCCGGCGGTACCTGTTGCACGAGCAGCGCGAGGACGGC

ACGTGGGCCCTGTACCCGGGTGGGCCGCCGGACCTCGACACGACCATCGAGGCGTACGTCGCGCTCAAGTATATCG

GCATGTCGCGCGACGAGGAGCCGATGCAGAAGGCGCTCCGGTTCATTCAGAGCCAGGGCGGGATCGAGTCGTCGCG

CGTGCTCACGCGGATGTGGCTGGCGCTGGTGGGAGAATATCCGTGGGAGAAGGTGCCCATGGTCCCGCCGGAGATC

ATGTTCCTCGGCAAGCGCATGCCGCTCAACATCTACGAGTTTGGCTCGTGGGCTCGGGCGACCGTCGTGGCGCTCT

CGATTGTGATGAGCCGCCAGCCGGTGTTCCCGCTGCCCGAGCGGGCGCGCGTGCCCGAGCTGTACGAGACCGACGT

GCCTCCGCGCCGGCGCGGTGCCAAGGGAGGGGGTGGGTGGATCTTCGACGCGCTCGACCGGGCGCTGCACGGGTAT

CAGAAGCTGTCGGTGCACCCGTTCCGCCGCGCGGCCGAGATCCGCGCCTTGGACTGGTTGCTCGAGCGCCAGGCCG

GAGACGGCAGCTGGGGCGGGATTCAGCCGCCTTGGTTTTACGCGCTCATCGCGCTCAAGATTCTCGACATGACGCA

GCATCCGGCGTTCATCAAGGGCTGGGAAGGTCTAGAGCTGTACGGCGTGGAGCTGGATTACGGAGGATGGATGTTT

CAGGCTTCCATCTCGCCGGTGTGGGACACGGGCCTCGCCGTGCTCGCGCTGCGCGCTGCGGGGCTTCCGGCCGATC

ACGACCGCTTGGTCAAGGCGGGCGAGTGGCTGTTGGACCGGCAGATCACGGTTCCGGGCGACTGGGCGGTGAAGCG

CCCGAACCTCAAGCCGGGCGGGTTCGCGTTCCAGTTCGACAACGTGTACTACCCGGACGTGGACGACACGGCCGTC

GTGGTGTGGGCGCTCAACACCCTGCGCTTGCCGGACGAGCGCCGCAGGCGGGACGCCATGACGAAGGGATTCCGCT

GGATTGTCGGCATGCAGAGCTCGAACGGCGGTTGGGGCGCCTACGACGTCGACAACACGAGCGATCTCCCGAACCA

CATCCCGTTCTGCGACTTCGGCGAAGTGACCGATCCGCCGTCAGAGGACGTCACCGCCCACGTGCTCGAGTGTTTC

GGCAGCTTCGGGTACGATGACGCCTGGAAGGTCATCCGGCGCGCGGTGGAATATCTCAAGCGGGAGCAGAAGCCGG

ACGGCAGCTGGTTCGGTCGTTGGGGCGTCAATTACCTCTACGGCACGGGCGCGGTGGTGTCGGCGCTGAAGGCGGT

CGGGATCGACACGCGCGAGCCGTACATTCAAAAGGCGCTCGACTGGGTCGAGCAGCATCAGAACCCGGACGGCGGC

TGGGGCGAGGACTGCCGCTCGTACGAGGATCCGGCGTACGCGGGTAAGGGCGCGAGCACCCCGTCGCAGACGGCCT

GGGCGCTGATGGCGCTCATCGCGGGCGGCAGGGCGGAGTCCGAGGCCGCGCGCCGCGGCGTGCAATACCTCGTGGA

GACGCAGCGCCCGGACGGCGGCTGGGATGAGCCGTACTACACCGGCACGGGCTTCCCAGGGGATTTCTACCTCGGC

TACACCATGTACCGCCACGTGTTTCCGACGCTCGCGCTCGGCCGCTACAAGCAAGCCATCGAGCGCAGGTGA

Variant SHC10
(SEQ ID No. 31)
MAEQLVEAPAYARTLDRAVEYLLSCQKDEGYWWGPLLSNVTMEAEYVLLCHILDRVDRDRMEKIRRYLLHEQREDG

TWALYPGGPPDLDTTIEAYVALKYIGMSRDEEPMQKALRFIQSQGGIESSRVLTRMWLALVGEYPWEKVPMVPPEI

MFLGKRMPLNIYEFGSWARATVVALSIVMSRQPVFPLPERARVPELYETDVPPRRRGAKGGGGWIFDALDRALHGY

-continued

QKLSVHPFRRAAEIRALDWLLERQAGDGSWGGIQPPWFYALIALKILDMTQHPAFIKGWEGLELYGVELDYGGWMF

QASISPVWDTGLAVLALRAAGLPADHDRLVKAGEWLLDRQITVPGDWAVKRPNLKPGGFAFQFDNVYYPDVDDTAV

VVWALNTLRLPDERRRRDAMTKGFRWIVGMQSSNGGWGAYDVDNTSDLPNHIPFCDFGEVTDPPSEDVTAHVLECF

GSFGYDDAWKVIRRAVEYLKREQKPDGSWFGRWGVNYLYGTGAVVSALKAVGIDTREPYIQKALDWVEQHQNPDGG

WGEDCRSYEDPAYAGKGASTPSQTAWALMALIAGGRAESEAARRGVQYLVETQRPDGGWDEPYYTGTGFPGDFYLG

YTMYRHVFPTLALGRYKQAIERR

Variant S11C26

(SEQ ID No. 24)

ATGGCTGAGCAGTTGGTGGAAGCTCCGGCCTACGCGCGGACGCTGGATCGCGCGGTGGAGTATCTCCTCTCCTGCC

AAAAGGACGAAGGCTACTGGTGGGGGCCGCTTCTGAGCAACGTCACGATGGAAGCGGAGTACGTCCTCTTGTGCCA

CATTCTCGATCGCGTCGATCGGGATCGCATGGAGAAGATCCGGCGGTACCTGTTGCACGAGCAGCGCGAGGACGGC

ACGTGGGCCCTGTACCCGGGTGGGCCGCCGGACCTCGACACGACCATCGAGGCGTACGTCGCGCTCAAGTATATCG

GCATGTCGCGCGACGAGGAGCCGATGCAGAAGGCGCTCCGGTTCATTCAGAGCCAGGGCGGGATCGAGTCGTCGCG

CGTGTTCACGCGGAGGTGGCTGGCGCTGGTGGGAGAATATCCGTGGGAGAAGGTGCCCATGGTCCCGCCGGAGATC

ATGTTCCTCGGCAAGCGCATGCCGCTCAACATCTACGAGTTTGGCTCGTGGGCTCGGGCGACCGTCGTGGCGCTCT

CGATTGTGATGAGCCGCCAGCCGGTGTTCCCGCTGCCCGAGCGGGCGCGCGTGCCCGAGCTGTACGAGACCGACGT

GCCTCCGCGCCGGCGCGGTGCCAAGGGAGGGGGTGGGTGGATCTTCGACGCGCTCGACCGGGCGCTGCACGGGTAT

CAGAAGCTGTCGGTGCACCCGTTCCGCCGCGCGGCCGAGATCCGCGCCTTGGACTGGTTGCTCGAGCGCCAGGCCG

GAGACGGCAGCTGGGGCGGGATTCAGCCGCCTTGGTTTTACGCGCTCATCGCGCTCAAGATTCTCGACATGACGCA

GCATCCGGCGTTCATCAAGGGCTGGGAAGGTCTAGAGCTGTACGGCGTGGAGCTGGATTACGGAGGATGGATGTTT

CAGGCTTCCATCTCGCCGGTGTGGGACACGGGCCTCGCCGTGCTCGCGCTGCGCGCTGCGGGGCTTCCGGCCGATC

ACGACCGCTTGGTCAAGGCGGGCGAGTGGCTGTTGGACCGGCAGATCACGGTTCCGGGCGACTGGGCGGTGAAGCG

CCCGAACCTCAAGCCGGGCGGGTTCGCGTTCCAGTTCGACAACGTGTACTACCCGGACGTGGACGACACGGCCGTC

GTGGTGTGGGCGCTCAACACCCTGCGCTTGCCGGACGAGCGCCGCAGGCGGGACGCCATGACGAAGGGATTCCGCT

GGATTGTCGGCATGCAGAGCTCGAACGGCGGTTGGGGCGCCTACGACGTCGACAACACGAGCGATCTCCCGAACCA

CACCCCGTTCTGCGACTTCGGCGAAGTGACCGATCCGCCGTCAGAGGACGTCACCGCCCACGTGCTCGAGTGTTTC

GGCAGCTTCGGGTACGATGACGCCTGGAAGGTCATCCGGCGCGCGGTGGAATATCTCAAGCGGGAGCAGAAGCCGG

ACGGCAGCTGGTTCGGTCGTTGGGGCGTCAATTACCTCTACGGCACGGGCGCGGTGGTGTCGGCGCTGAAGGCGGT

CGGGATCGACACGCGCGAGCCGTACATTCAAAAGGCGCTCGACTGGGTCGAGCAGCATCAGAACCCGGACGGCGGC

TGGGGCGAGGACTGCCGCTCGTACGAGGATCCGGCGTACGCGGGTAAGGGCGCGAGCACCCCGTCGCAGACGGCCT

GGGCGCTGATGGCGCTCATCGCGGGCGGCAGGGCGGAGTCCGAGGCCGCGCGCCGCGGCGTGCAATACCTCGTGGA

GACGCAGCGCCCGGACGGCGGCTGGGATGAGCCGTACTACACCGGCACGGGCTTCCCAGGGGATTTCTACCTCGGC

TACACCATGTACCGCCACGTGTTTCCGACGCTCGCGCTCGGCCGCTACAAGCAAGCCATCGAGCGCAGGTGA

Variant S11C26

(SEQ ID No. 23)

MAEQLVEAPAYARTLDRAVEYLLSCQKDEGYWWGPLLSNVTMEAEYVLLCHILDRVDRDRMEKIRRYLLHEQREDG

TWALYPGGPPDLDTTIEAYVALKYIGMSRDEEPMQKALRFIQSQGGIESSRVFTRRWLALVGEYPWEKVPMVPPEI

MFLGKRMPLNIYEFGSWARATVVALSIVMSRQPVFPLPERARVPELYETDVPPRRRGAKGGGGWIFDALDRALHGY

QKLSVHPFRRAAEIRALDWLLERQAGDGSWGGIQPPWFYALIALKILDMTQHPAFIKGWEGLELYGVELDYGGWMF

QASISPVWDTGLAVLALRAAGLPADHDRLVKAGEWLLDRQITVPGDWAVKRPNLKPGGFAFQFDNVYYPDVDDTAV

VVWALNTLRLPDERRRRDAMTKGFRWIVGMQSSNGGWGAYDVDNTSDLPNHTPFCDFGEVTDPPSEDVTAHVLECF

GSFGYDDAWKVIRRAVEYLKREQKPDGSWFGRWGVNYLYGTGAVVSALKAVGIDTREPYIQKALDWVEQHQNPDGG

WGEDCRSYEDPAYAGKGASTPSQTAWALMALIAGGRAESEAARRGVQYLVETQRPDGGWDEPYYTGTGFPGDFYLG

YTMYRHVFPTLALGRYKQAIERR

Variant 511C30

(SEQ ID No. 34)

ATGGCTGAGCAGTTGGTGGAAGCGCCGGCCTACGCGCGGACGCTGGATCGCGCGGTGGAGTATCTCCTCTCCTGCC

AAAAGGACGAAGGCTACTGGTGGGGCCGCTTCTGAGCAACGTCACGATGGAAGCGGAGTACGTCCTCTTGTGCCA

CATTCTCGATCGCGTCGATCGGGATCGCATGGAGAAGATCCGGCGGTACCTGTTGCACGAGCAGCGCGAGGACGGC

ACGTGGGCCCTGTACCCGGGTGGGCCGCCGGACCTCGACACGACCATCGAGGCGTACGTCGCGCTCAAGTATATCG

GCATGTCGCGCGACGAGGAGCCGATGCAGAAGGCGCTCCGGTTCATTCAGAGCCAGGGCGGGATCGAGTCGTCGCG

CGTGCTCACGCGGATGTGGCTGGCGCTGGTGGGAGAATATCCGTGGGAGAAGGTGCCCATGGTCCCGCCGGAGATC

ATGTTCCTCGGCAAGCGCATGCCGCTCAACATCTACGAGTTTGGCTCGTGGGCTCGGGCGACCGTCGTGGCGCTCT

CGATTGTGATGAGCCGCCAGCCGGTGTTCCCGCTGCCCGAGCGGGCGCGCGTGCCCGAGCTGTACGAGACCGACGT

GCCTCCGCGCCGGCGCGGTGCCAAGGGAGGGGGTGGGTGGATCTTCGACGCGCTCGACCGGGCGCTGCACGGGTAT

CAGAAGCTGTCGGTGCACCCGTTCCGCCGCGCGGCCGAGATCCGCGCCTTGGACTGGTTGCTCGAGCGCCAGGCCG

GAGACGGCAGCTGGGGCGGGATTCAGCCGCCTTGGTTTTACGCGCTCATCGCGCTCAAGATTCTCGACATGACGCA

GCATCCGGCGTTCATCAAGGGCTGGGAAGGTCTAGAGCTGTACGGCGTGGAGCTGGATTACGGAGGATGGATGTTT

CAGGCTTCCATCTCGCCGGTGTGGGACACGGGCCTCGCCGTGCTCGCGCTGCGCGCTGCGGGGCTTCCGGCCGATC

ACGACCGCTTGGTCAAGGCGGGCGAGTGGCTGTTGGACCGGCAGATCACGGTTCCGGGCGACTGGGCGGTGAAGCG

CCCGAACCTCAAGCCGGGCGGGTTCGCGTTCCAGTTCGACAACGTGTACTACCCGGACGTGGACGACACGGCCGTC

GTGGTGTGGGCGCTCAACACCCTGCGCTTGCCGGACGAGCGCCGCAGGCGGGACGCCATGACGAAGGGATTCCGCT

GGATTGTCGGCATGCAGAGCTCGAACGGCGGTTGGGGCGCCTACGACGTCGACAACACGAGCGATCTCCCGAACCA

CATCCCGTTCTGCGACTTCGGCGAAGTGACCGATCCGCCGTCAGAGGACGTCACCGCCCACGTGCTCGAGTGTTTC

GGCAGCTTCGGGTACGATGACGCCTGGAAGGTCATCCGGCGCGCGGTGGAATATCTCAAGCGGGAGCAGAAGCCGG

ACGGCAGCTGGTTCGGTCGTTGGGGCGTCAATTACCTCTACGGCACGGGCGCGGTGGTGTCGGCGCTGAAGGCGGT

CGGGATCGACACGCGCGAGCCGTACATTCAAAAGGCGCTCGACTGGGTCGAGCAGCATCAGAACCCGGACGGCGGC

TGGGGCGAGGACTGCCGCTCGTACGAGGATCCGGCGTACGCGGGTAAGGGCGCGAGCACCCCGTCGCAGACGGCCT

GGGCGCTGATGGCGCTCATCGCGGGCGGCAGGGCGGAGTCCGAGGCCGCGCGCCGCGGCGTGCAATACCTCGTGGA

GACGCAGCGCCCGGACGGCGGCTGGGATGAGCCGTACTACACCGGCACGGGCTACCCAGGGGATTTCTACCTCGGC

TACACCATGTACCGCCACGTGTTTCCGACGCTCGCGCTCGGCCGCTACAAGCAAGCCATCGAGCGCAGGTGA

Variant SHC30

(SEQ ID No. 33)

MAEQLVEAPAYARTLDRAVEYLLSCQKDEGYWWGPLLSNVTMEAEYVLLCHILDRVDRDRMEKIRRYLLHEQREDG

TWALYPGGPPDLDTTIEAYVALKYIGMSRDEEPMQKALRFIQSQGGIESSRVLTRMWLALVGEYPWEKVPMVPPEI

MFLGKRMPLNIYEFGSWARATVVALSIVMSRQPVFPLPERARVPELYETDVPPRRRGAKGGGGWIFDALDRALHGY

QKLSVHPFRRAAEIRALDWLLERQAGDGSWGGIQPPWFYALIALKILDMTQHPAFIKGWEGLELYGVELDYGGWMF

QASISPVWDTGLAVLALRAAGLPADHDRLVKAGEWLLDRQITVPGDWAVKRPNLKPGGFAFQFDNVYYPDVDDTAV

VVWALNTLRLPDERRRDAMTKGFRWIVGMQSSNGGWGAYDVDNTSDLPNHIPFCDFGEVTDPPSEDVTAHVLECF

GSFGYDDAWKVIRRAVEYLKREQKPDGSWFGRWGVNYLYGTGAVVSALKAVGIDTREPYIQKALDWVEQHQNPDGG

WGEDCRSYEDPAYAGKGASTPSQTAWALMALIAGGRAESEAARRGVQYLVETQRPDGGWDEPYYTGTGYPGDFYLG

YTMYRHVFPTLALGRYKQAIERR

Variant 511C31

(SEQ ID No. 36)
ATGGCTGAGCAGTTGGTGGAAGCGCCGGCCTACGCGCGGACGCTGGATCGCGCGGTGGAGTATCTCCTCTCCTGCC

AAAAGGACGAAGGCTACTGGTGGGGGCCGCTTCTGAGCAACGTCACGATGGAAGCGGAGTACGTCCTCTTGTGCCA

CATTCTCGATCGCGTCGATCGGGATCGCATGGAGAAGATCCGGCGGTACCTGTTGCACGAGCAGCGCGAGGACGGC

ACGTGGGCCCTGTACCCGGGTGGGCCGCCGGACCTCGACACGACCATCGAGGCGTACGTCGCGCTCAAGTATATCG

GCATGTCGCGCGACGAGGAGCCGATGCAGAAGGCGCTCCGGTTCATTCAGAGCCAGGGCGGGATCGAGTCGTCGCG

CGTGCTCACGCGGAGGTGGCTGGCGCTGGTGGGAGAATATCCGTGGGAGAAGGTGCCCATGGTCCCGCCGGAGATC

ATGTTCCTCGGCAAGCGCATGCCGCTCAACATCTACGAGTTTGGCTCGTGGGCTCGGCGACCGTCGTGGCGCTCT

CGATTGTGATGAGCCGCCAGCCGGTGTTCCCGCTGCCCGAGCGGGCGCGCGTGCCCGAGCTGTACGAGACCGACGT

GCCTCCGCGCCGGCGCGGTGCCAAGGGAGGGGGTGGGTGGATCTTCGACGCGCTCGACCGGGCGCTGCACGGGTAT

CAGAAGCTGTCGGTGCACCCGTTCCGCCGCGCGGCCGAGATCCGCGCCTTGGACTGGTTGCTCGAGCGCCAGGCCG

GAGACGGCAGCTGGGGCGGGATTCAGCCGCCTTGGTTTTACGCGCTCATCGCGCTCAAGATTCTCGACATGACGCA

GCATCCGGCGTTCATCAAGGGCTGGGAAGGTCTAGAGCTGTACGGCGTGGAGCTGGATTACGGAGGATGGATGTTT

CAGGCTTCCATCTCGCCGGTGTGGGACACGGGCCTCGCCGTGCTCGCGCTGCGCGCTGCGGGGCTTCCGGCCGATC

ACGACCGCTTGGTCAAGGCGGGCGAGTGGCTGTTGGACCGGCAGATCACGGTTCCGGGCGACTGGGCGGTGAAGCG

CCCGAACCTCAAGCCGGGCGGGTTCGCGTTCCAGTTCGACAACGTGTACTACCCGGACGTGGACGACACGGCCGTC

GTGGTGTGGGCGCTCAACACCCTGCGCTTGCCGGACGAGCGCCGCAGGCGGGACGCCATGACGAAGGGATTCCGCT

GGATTGTCGGCATGCAGAGCTCGAACGGCGGTTGGGGCGCCTACGACGTCGACAACACGAGCGATCTCCCGAACCA

CACCCCGTTCTGCGACTTCGGCGAAGTGACCGATCCGCCGTCAGAGGACGTCACCGCCCACGTGCTCGAGTGTTTC

GGCAGCTTCGGGTACGATGACGCCTGGAAGGTCATCCGGCGCGCGGTGGAATATCTCAAGCGGGAGCAGAAGCCGG

ACGGCAGCTGGTTCGGTCGTTGGGGCGTCAATTACCTCTACGGCACGGGCGCGGTGGTGTCGGCGCTGAAGGCGGT

CGGGATCGACACGCGCGAGCCGTACATTCAAAAGGCGCTCGACTGGGTCGAGCAGCATCAGAACCCGGACGGCGGC

TGGGGCGAGGACTGCCGCTCGTACGAGGATCCGGCGTACGCGGGTAAGGGCGCGAGCACCCCGTCGCAGACGGCCT

GGGCGCTGATGGCGCTCATCGCGGGCGGCAGGGCGGAGTCCGAGGCCGCGCGCCGCGGCGTGCAATACCTCGTGGA

GACGCAGCGCCCGGACGGCGGCTGGGATGAGCCGTACTACACCGGCACGGGCTTCCCAGGGGATTTCTACCTCGGC

TACACCATGTACCGCCACGTGTTTCCGACGCTCGCGCTCGGCCGCTACAAGCAAGCCATCGAGCGCAGGTGA

Variant 511C31

(SEQ ID No. 35)
MAEQLVEAPAYARTLDRAVEYLLSCQKDEGYWWGPLLSNVTMEAEYVLLCHILDRVDRDRMEKIRRYLLHEQREDG

TWALYPGGPPDLDTTIEAYVALKYIGMSRDEEPMQKALRFIQSQGGIESSRVLTRRWLALVGEYPWEKVPMVPPEI

MFLGKRMPLNIYEFGSWARATVVALSIVMSRQPVFPLPERARVPELYETDVPPRRRGAKGGGGWIFDALDRALHGY

QKLSVHPFRRAAEIRALDWLLERQAGDGSWGGIQPPWFYALIALKILDMTQHPAFIKGWEGLELYGVELDYGGWMF

QASISPVWDTGLAVLALRAAGLPADHDRLVKAGEWLLDRQITVPGDWAVKRPNLKPGGFAFQFDNVYYPDVDDTAV

VVWALNTLRLPDERRRDAMTKGFRWIVGMQSSNGGWGAYDVDNTSDLPNHTPFCDFGEVTDPPSEDVTAHVLECF

GSFGYDDAWKVIRRAVEYLKREQKPDGSWFGRWGVNYLYGTGAVVSALKAVGIDTREPYIQKALDWVEQHQNPDGG

WGEDCRSYEDPAYAGKGASTPSQTAWALMALIAGGRAESEAARRGVQYLVETQRPDGGWDEPYYTGTGFPGDFYLG

YTMYRHVFPTLALGRYKQAIERR

Variant S11C32

(SEQ ID No. 38)
ATGGCTGAGCAGTTGGTGGAAGCGCCGGCCTACGCGCGGACGCTGGATCGCGCGGTGGAGTATCTCCTCTCCTGCC

AAAAGGACGAAGGCTACTGGTGGGGGCCGCTTCTGAGCAACGTCACGATGGAAGCGGAGTACGTCCTCTTGTGCCA

CATTCTCGATCGCGTCGATCGGGATCGCATGGAGAAGATCCGGCGGTACCTGTTGCACGAGCAGCGCGAGGACGGC

-continued

```
ACGTGGGCCCTGTACCCGGGTGGGCCGCCGGACCTCGACACGACCATCGAGGCGTACGTCGCGCTCAAGTATATCG

GCATGTCGCGCGACGAGGAGCCGATGCAGAAGGCGCTCCGGTTCATTCAGAGCCAGGGCGGGATCGAGTCGTCGCG

CGTGTTCACGCGGAGGTGGCTGGCGCTGGTGGGAGAATATCCGTGGGAGAAGGTGCCCATGGTCCCGCCGGAGATC

ATGTTCCTCGGCAAGCGCATGCCGCTCAACATCTACGAGTTTGGCTCGTGGGCTCGGGCGACCGTCGTGGCGCTCT

CGATTGTGATGAGCCGCCAGCCGGTGTTCCCGCTGCCCGAGCGGGCGCGCGTGCCCGAGCTGTACGAGACCGACGT

GCCTCCGCGCCGGCGCGGTGCCAAGGGAGGGGGTGGGTGGATCTTCGACGCGCTCGACCGGGCGCTGCACGGGTAT

CAGAAGCTGTCGGTGCACCCGTTCCGCCGCGCGGCCGAGATCCGCGCCTTGGACTGGTTGCTCGAGCGCCAGGCCG

GAGACGGCAGCTGGGGCGGGATTCAGCCGCCTTGGTTTTACGCGCTCATCGCGCTCAAGATTCTCGACATGACGCA

GCATCCGGCGTTCATCAAGGGCTGGGAAGGTCTAGAGCTGTACGGCGTGGAGCTGGATTACGGAGGATGGATGTTT

CAGGCTTCCATCTCGCCGGTGTGGGACACGGGCCTCGCCGTGCTCGCGCTGCGCGCTGCGGGGCTTCCGGCCGATC

ACGACCGCTTGGTCAAGGCGGGCGAGTGGCTGTTGGACCGGCAGATCACGGTTCCGGGCGACTGGGCGGTGAAGCG

CCCGAACCTCAAGCCGGGCGGGTTCGCGTTCCAGTTCGACAACGTGTACTACCCGGACGTGGACGACACGGCCGTC

GTGGTGTGGGCGCTCAACACCCTGCGCTTGCCGGACGAGCGCCGCAGGCGGGACGCCATGACGAAGGGATTCCGCT

GGATTGTCGGCATGCAGAGCTCGAACGGCGGTTGGGGCGCCTACGACGTCGACAACACGAGCGATCTCCCGAACCA

CACCCCGTTCTGCGACTTCGGCGAAGTGACCGATCCGCCGTCAGAGGACGTCACCGCCCACGTGCTCGAGTGTTTC

GGCAGCTTCGGGTACGATGACGCCTGGAAGGTCATCCGGCGCGCGGTGGAATATCTCAAGCGGGAGCAGAAGCCGG

ACGGCAGCTGGTTCGGTCGTTGGGGCGTCAATTACCTCTACGGCACGGGCGCGGTGGTGTCGGCGCTGAAGGCGGT

CGGGATCGACACGCGCGAGCCGTACATTCAAAAGGCGCTCGACTGGGTCGAGCAGCATCAGAACCCGGACGGCGGC

TGGGGCGAGGACTGCCGCTCGTACGAGGATCCGGCGTACGCGGGTAAGGGCGCGAGCACCCCGTCGCAGACGGCCT

GGGCGCTGATGGCGCTCATCGCGGGCGGCAGGGCGGAGTCCGAGGCCGCGCGCCGCGGCGTGCAATACCTCGTGGA

GACGCAGCGCCCGGACGGCGGCTGGGATGAGCCGTACTACACCGGCACGGGCTACCAGGGGATTTCTACCTCGGC

TACACCATGTACCGCCACGTGTTTCCGACGCTCGCGCTCGGCCGCTACAAGCAAGCCATCGAGCGCAGGTGA
```

Variant S11C32
(SEQ ID No. 37)
```
MAEQLVEAPAYARTLDRAVEYLLSCQKDEGYWWGPLLSNVTMEAEYVLLCHILDRVDRDRMEKIRRYLLHEQREDG

TWALYPGGPPDLDTTIEAYVALKYIGMSRDEEPMQKALRFIQSQGGIESSRVFTRRWLALVGEYPWEKVPMVPPEI

MFLGKRMPLNIYEFGSWARATVVALSIVMSRQPVFPLPERARVPELYETDVPPRRRGAKGGGGWIFDALDRALHGY

QKLSVHPFRRAAEIRALDWLLERQAGDGSWGGIQPPWFYALIALKILDMTQHPAFIKGWEGLELYGVELDYGGWMF

QASISPVWDTGLAVLALRAAGLPADHDRLVKAGEWLLDRQITVPGDWAVKRPNLKPGGFAFQFDNVYYPDVDDTAV

VVWALNTLRLPDERRRRDAMTKGFRWIVGMQSSNGGWGAYDVDNTSDLPNHTPFCDFGEVTDPPSEDVTAHVLECF

GSFGYDDAWKVIRRAVEYLKREQKPDGSWFGRWGVNYLYGTGAVVSALKAVGIDTREPYIQKALDWVEQHQNPDGG

WGEDCRSYEDPAYAGKGASTPSQTAWALMALIAGGRAESEAARRGVQYLVETQRPDGGWDEPYYTGTGYPGDFYLG

YTMYRHVFPTLALGRYKQAIERR
```

Variant S11C33
(SEQ ID No. 40)
```
ATGGCTGAGCAGTTGGTGGAAGCGCCGGCCTACGCGCGGACGCTGGATCGCGCGGTGGAGTATCTCCTCTCCTGCC

AAAAGGACGAAGGCTACTGGTGGGGGCCGCTTCTGAGCAACGTCACGATGGAAGCGGAGTACGTCCTCTTGTGCCA

CATTCTCGATCGCGTCGATCGGGATCGCATGGAGAAGATCCGGCGGTACCTGTTGCACGAGCAGCGCGAGGACGGC

ACGTGGGCCCTGTACCCGGGTGGGCCGCCGGACCTCGACACGACCATCGAGGCGTACGTCGCGCTCAAGTATATCG

GCATGTCGCGCGACGAGGAGCCGATGCAGAAGGCGCTCCGGTTCATTCAGAGCCAGGGCGGGATCGAGTCGTCGCG

CGTGCTCACGCGGAGGTGGCTGGCGCTGGTGGGAGAATATCCGTGGGAGAAGGTGCCCATGGTCCCGCCGGAGATC

ATGTTCCTCGGCAAGCGCATGCCGCTCAACATCTACGAGTTTGGCTCGTGGGCTCGGGCGACCGTCGTGGCGCTCT

CGATTGTGATGAGCCGCCAGCCGGTGTTCCCGCTGCCCGAGCGGGCGCGCGTGCCCGAGCTGTACGAGACCGACGT
```

-continued

```
GCCTCCGCGCCGGCGCGGTGCCAAGGGAGGGGGTGGGTGGATCTTCGACGCGCTCGACCGGGCGCTGCACGGGTAT

CAGAAGCTGTCGGTGCACCCGTTCCGCCGCGCGGCCGAGATCCGCGCCTTGGACTGGTTGCTCGAGCGCCAGGCCG

GAGACGGCAGCTGGGGCGGGATTCAGCCGCCTTGGTTTTACGCGCTCATCGCGCTCAAGATTCTCGACATGACGCA

GCATCCGGCGTTCATCAAGGGCTGGGAAGGTCTAGAGCTGTACGGCGTGGAGCTGGATTACGGAGGATGGATGTTT

CAGGCTTCCATCTCGCCGGTGTGGGACACGGGCCTCGCCGTGCTCGCGCTGCGCGCTGCGGGGCTTCCGGCCGATC

ACGACCGCTTGGTCAAGGCGGGCGAGTGGCTGTTGGACCGGCAGATCACGGTTCCGGGCGACTGGGCGGTGAAGCG

CCCGAACCTCAAGCCGGGCGGGTTCGCGTTCCAGTTCGACAACGTGTACTACCCGGACGTGGACGACACGGCCGTC

GTGGTGTGGGCGCTCAACACCCTGCGCTTGCCGGACGAGCGCCGCAGGCGGGACGCCATGACGAAGGGATTCCGCT

GGATTGTCGGCATGCAGAGCTCGAACGGCGGTTGGGGCGCCTACGACGTCGACAACACGAGCGATCTCCCGAACCA

CACCCCGTTCTGCGACTTCGGCGAAGTGACCGATCCGCCGTCAGAGGACGTCACCGCCCACGTGCTCGAGTGTTTC

GGCAGCTTCGGGTACGATGACGCCTGGAAGGTCATCCGGCGCGCGGTGGAATATCTCAAGCGGGAGCAGAAGCCGG

ACGGCAGCTGGTTCGGTCGTTGGGGCGTCAATTACCTCTACGGCACGGGCGCGGTGGTGTCGGCGCTGAAGGCGGT

CGGGATCGACACGCGCGAGCCGTACATTCAAAAGGCGCTCGACTGGGTCGAGCAGCATCAGAACCCGGACGGCGGC

TGGGGCGAGGACTGCCGCTCGTACGAGGATCCGGCGTACGCGGGTAAGGGCGCGAGCACCCCGTCGCAGACGGCCT

GGGCGCTGATGGCGCTCATCGCGGGCGGCAGGGCGGAGTCCGAGGCCGCGCGCCGCGGCGTGCAATACCTCGTGGA

GACGCAGCGCCCGGACGGCGGCTGGGATGAGCCGTACTACACCGGCACGGGCTACCCAGGGGATTTCTACCTCGGC

TACACCATGTACCGCCACGTGTTTCCGACGCTCGCGCTCGGCCGCTACAAGCAAGCCATCGAGCGCAGGTGA
```

Variant 511C33

(SEQ ID No. 39)

```
MAEQLVEAPAYARTLDRAVEYLLSCQKDEGYWWGPLLSNVTMEAEYVLLCHILDRVDRDRMEKIRRYLLHEQREDG

TWALYPGGPPDLDTTIEAYVALKYIGMSRDEEPMQKALRFIQSQGGIESSRVLTRRWLALVGEYPWEKVPMVPPEI

MFLGKRMPLNIYEFGSWARATVVALSIVMSRQPVFPLPERARVPELYETDVPPRRRGAKGGGGWIFDALDRALHGY

QKLSVHPFRRAAEIRALDWLLERQAGDGSWGGIQPPWFYALIALKILDMTQHPAFIKGWEGLELYGVELDYGGWMF

QASISPVWDTGLAVLALRAAGLPADHDRLVKAGEWLLDRQITVPGDWAVKRPNLKPGGFAFQFDNVYYPDVDDTAV

VVWALNTLRLPDERRRRDAMTKGFRWIVGMQSSNGGWGAYDVDNTSDLPNHTPFCDFGEVTDPPSEDVTAHVLECF

GSFGYDDAWKVIRRAVEYLKREQKPDGSWFGRWGVNYLYGTGAVVSALKAVGIDTREPYIQKALDWVEQHQNPDGG

WGEDCRSYEDPAYAGKGASTPSQTAWALMALIAGGRAESEAARRGVQYLVETQRPDGGWDEPYYTGTGYPGDFYLG

YTMYRHVFPTLALGRYKQAIERR
```

Variant F605W (SEQ ID No. 170)

```
ATGGCTGAGCAGTTGGTGGAAGCGCCGGCCTACGCGCGGACGCTGGATCGCGCGGTGGAGTATCTCCTCTCCTGCC

AAAAGGACGAAGGCTACTGGTGGGGGCCGCTTCTGAGCAACGTCACGATGGAAGCGGAGTACGTCCTCTTGTGCCA

CATTCTCGATCGCGTCGATCGGGATCGCATGGAGAAGATCCGGCGGTACCTGTTGCACGAGCAGCGCGAGGACGGC

ACGTGGGCCCTGTACCCGGGTGGGCCGCCGGACCTCGACACGACCATCGAGGCGTACGTCGCGCTCAAGTATATCG

GCATGTCGCGCGACGAGGAGCCGATGCAGAAGGCGCTCCGGTTCATTCAGAGCCAGGGCGGGATCGAGTCGTCGCG

CGTGTTCACGCGGATGTGGCTGGCGCTGGTGGGAGAATATCCGTGGGAGAAGGTGCCGATGGTCCCGCCGGAGATC

ATGTTCCTCGGCAAGCGCATGCCGCTCAACATCTACGAGTTTGGCTCGTGGGCTCGGGCGACCGTCGTGGCGCTCT

CGATTGTGATGAGCCGCCAGCCGGTGTTCCCGCTGCCCGAGCGGGCGCGCGTGCCCGAGCTGTACGAGACCGACGT

GCCTCCGCGCCGGCGCGGTGCCAAGGGAGGGGGTGGGTGGATCTTCGACGCGCTCGACCGGGCGCTGCACGGGTAT

CAGAAGCTGTCGGTGCACCCGTTCCGCCGCGCGGCCGAGATCCGCGCCTTGGACTGGTTGCTCGAGCGCCAGGCCG

GAGACGGCAGCTGGGGCGGGATTCAGCCGCCTTGGTTTTACGCGCTCATCGCGCTCAAGATTCTCGACATGACGCA

GCATCCGGCGTTCATCAAGGGCTGGGAAGGTCTAGAGCTGTACGGCGTGGAGCTGGATTACGGAGGATGGATGTTT
```

-continued

```
CAGGCTTCCATCTCGCCGGTGTGGGACACGGGCCTCGCCGTGCTCGCGCTGCGCGCTGCGGGGCTTCCGGCCGATC
ACGACCGCTTGGTCAAGGCGGGCGAGTGGCTGTTGGACCGGCAGATCACGGTTCCGGGCGACTGGGCGGTGAAGCG
CCCGAACCTCAAGCCGGGCGGGTTCGCGTTCCAGTTCGACAACGTGTACTACCCGGACGTGGACGACACGGCCGTC
GTGGTGTGGGCGCTCAACACCCTGCGCTTGCCGGACGAGCGCCGCAGGCGGGACGCCATGACGAAGGGATTCCGCT
GGATTGTCGGCATGCAGAGCTCGAACGGCGGTTGGGGCGCCTACGACGTCGACAACACGAGCGATCTCCCGAACCA
CATCCCGTTCTGCGACTTCGGCGAAGTGACCGATCCGCCGTCAGAGGACGTCACCGCCCACGTGCTCGAGTGTTTC
GGCAGCTTCGGGTACGATGACGCCTGGAAGGTCATCCGGCGCGCGGTGGAATATCTCAAGCGGGAGCAGAAGCCGG
ACGGCAGCTGGTTCGGTCGTTGGGGCGTCAATTACCTCTACGGCACGGGCGCGGTGGTGTCGGCGCTGAAGGCGGT
CGGGATCGACACGCGCGAGCCGTACATTCAAAAGGCGCTCGACTGGGTCGAGCAGCATCAGAACCCGGACGGCGGC
TGGGGCGAGGACTGCCGCTCGTACGAGGATCCGGCGTACGCGGGTAAGGGCGCGAGCACCCCGTCGCAGACGGCCT
GGGCGCTGATGGCGCTCATCGCGGGCGGCAGGGCGGAGTCCGAGGCCGCGCGCCGCGGCGTGCAATACCTCGTGGA
GACGCAGCGCCCGGACGGCGGCTGGGATGAGCCGTACTACACCGGCACGGGCTTCCCAGGGGATTGGTACCTCGGC
TACACCATGTACCGCCACGTGTTTCCGACGCTCGCGCTCGGCCGCTACAAGCAAGCCATCGAGCGCAGGTGA
```

Variant F605W (SEQ ID No. 171)

```
MAEQLVEAPAYARTLDRAVEYLLSCQKDEGYWWGPLLSNVTMEAEYVLLCHILDRVDRDRMEKIRRYLLHEQREDG
TWALYPGGPPDLDTTIEAYVALKYIGMSRDEEPMQKALRFIQSQGGIESSRVFTRMWLALVGEYPWEKVPMVPPEI
MFLGKRMPLNIYEFGSWARATVVALSIVMSRQPVFPLPERARVPELYETDVPPRRRGAKGGGGWIFDALDRALHGY
QKLSVHPFRRAAEIRALDWLLERQAGDGSWGGIQPPWFYALIALKILDMTQHPAFIKGWEGLELYGVELDYGGWMF
QASISPVWDTGLAVLALRAAGLPADHDRLVKAGEWLLDRQITVPGDWAVKRPNLKPGGFAFQFDNVYYPDVDDTAV
VVWALNTLRLPDERRRRDAMTKGFRWIVGMQSSNGGWGAYDVDNTSDLPNHIPFCDFGEVTDPPSEDVTAHVLECF
GSFGYDDAWKVIRRAVEYLKREQKPDGSWFGRWGVNYLYGTGAVVSALKAVGIDTREPYIQKALDWVEQHQNPDGG
WGEDCRSYEDPAYAGKGASTPSQTAWALMALIAGGRAESEAARRGVQYLVETQRPDGGWDEPYYTGTGFPGDWYLG
YTMYRHVFPTLALGRYKQAIERR
```

(ZmoSHC1)

SEQ ID No. 166

```
ATGGGTATTGACAGAATGAATAGCTTAAGTCGCTTGTTAATGAAGAAGATTTTCGGGGCTGAAAAAACCTCGTATA
AACCGGCTTCCGATACCATAATCGGAACGGATACCCTGAAAAGACCGAACCGGCGGCCTGAACCGACGGCAAAAGT
CGACAAAACGATATTCAAGACTATGGGGAATAGTCTGAATAATACCCTTGTTTCAGCCTGTGACTGGTTGATCGGA
CAACAAAAGCCCGATGGTCATTGGGTCGGTGCCGTGGAATCCAATGCTTCGATGGAAGCAGAATGGTGTCTGGCCT
TGTGGTTTTTGGGTCTGGAAGATCATCCGCTTCGTCAAGATTGGGCAATGCTCTTTTGGAAATGCAGCGGGAAGA
TGGCTCTTGGGGAGTCTATTTCGGCGCTGGAAATGGCGATATCAATGCCACGGTTGAAGCCTATGCGGCCTTGCGG
TCTTTGGGGTATTCTGCCGATAATCCTGTTTTGAAAAAAGCGGCAGCATGGATTGCTGAAAAAGGCGGATTAAAAA
ATATCCGTGTCTTTACCCGTTATTGGCTGGCGTTGATCGGGGAATGGCCTTGGGAAAAGACCCCTAACCTTCCCCC
TGAAATTATCTGGTTCCCTGATAATTTTGTCTTTTCGATTTATAATTTTGCCCAATGGGCGCGGGCAACCATGGTG
CCGATTGCTATTCTGTCCGCGAGACGACCAAGCCGCCCGCTGCGCCCTCAAGACCGATTGGATGAACTGTTTCCAG
AAGGCCGCGCTCGCTTTGATTATGAATTGCCGAAAAAAGAAGGCATCGATCTTTGGTCGCAATTTTTCCGAACCAC
TGACCGTGGATTACATTGGGTTCAGTCCAATCTGTTAAAGCGCAATAGCTTGCGTGAAGCCGCTATCCGTCATGTT
TTGGAATGGATTATCCGGCATCAGGATGCCGATGGCGGTTGGGGTGGAATTCAGCCACCTTGGGTCTATGGTTTGA
TGGCGTTACATGGTGAAGGCTATCAGCTTTATCATCCGGTGATGGCCAAGGCTTTGTCGGCTTTGGATGATCCCGG
TTGGCGACATGACAGAGGCGAGTCTTCTTGGATACAGGCCACCAATAGTCCGGTATGGGATACAATGTTGGCCTTG
ATGGCGTTAAAAGACGCCAAGGCCGAGGATCGTTTTACGCCGGAAATGGATAAGGCCGCCGATTGGCTTTTGGCTC
GACAGGTCAAAGTCAAAGGCGATTGGTCAATCAAACTGCCCGATGTTGAACCCGGTGGATGGGCATTTGAATATGC
```

-continued

CAATGATCGCTATCCCGATACCGATGATACCGCCGTCGCTTTGATCGCCCTTTCCTCTTATCGTGATAAGGAGGAG

TGGCAAAAGAAAGGCGTTGAGGACGCCATTACCCGTGGGGTTAATTGGTTGATCGCCATGCAAAGCGAATGTGGCG

GTTGGGGAGCCTTTGATAAGGATAATAACAGAAGTATCCTTTCCAAAATTCCTTTTTGTGATTTCGGAGAATCTAT

TGATCCGCCTTCAGTCGATGTAACGGCGCATGTTTTAGAGGCCTTTGGCACCTTGGGACTGTCCCGCGATATGCCG

GTCATCCAAAAAGCGATCGACTATGTCCGTTCCGAACAGGAAGCCGAAGGCGCGTGGTTTGGTCGTTGGGCGTTA

ATTATATCTATGGCACCGGTGCGGTTCTGCCTGCTTTGGCGGCGATCGGTGAAGATATGACCCAGCCTTACATCAC

CAAGGCTTGCGATTGGCTGGTCGCACATCAGCAGGAAGACGGCGGTTGGGGCGAAAGCTGCTCTTCCTATATGGAG

ATTGATTCCATTGGGAAGGGCCCAACCACGCCGTCCCAGACTGCTTGGGCTTTGATGGGGTTGATCGCGGCCAATC

GTCCCGAAGATTATGAAGCCATTGCCAAGGGATGCCATTATCTGATTGATCGCCAAGAGCAGGATGGTAGCTGGAA

AGAAGAAGAATTCACCGGCACCGGATTCCCCGGTTATGGCGTGGGTCAGACGATCAAGTTGGATGATCCGGCTTTA

TCGAAACGATTGCTTCAAGGCGCTGAACTGTCACGGGCGTTTATGCTGCGTTATGATTTTTATCGGCAATTCTTCC

CGATTATGGCGTTAAGTCGGGCAGAGAGACTGATTGATTTGAATAATTGA

TABLE 18 percent sequence identity calculations using Blast and GAP program algorithms for WT AacSHC enzyme relative to the WT SHC enzymes disclosed in WO2010/0139719 (BASF).

| Sequence alignment of WT AacSHC (631AA, SEQ ID No. 1) versus | % identity Blast maps | % identity GAP | Source of WT SHC (HAC) | Length (AA) |
|---|---|---|---|---|
| WO 2010139719 SEQ ID No. 1 | 44% | 40% | Zymomonas mobilis | 725 |
| WO 2010139719 SEQ ID No. 2 | 44% | 40% | Zymomonas mobilis | 725 |
| WO 2010139719 SEQ ID No. 5 | 44% | 42% | Bradyrhizobium japonicum | 684 |
| WO 2010139719 SEQ ID No. 6 | 41% | 38% | Burkholderia ambifaria6 | 657 |
| WO 2010139719 SEQ ID No. 7 | 40% | 37% | Burkholderia ambifaria | 682 |
| WO 2010139719 SEQ ID No. 8 | 34% | 32% | Bacillus anthracis | 617 |
| WO 2010139719 SEQ ID No. 9 | 37% | n.d. | Frankia alni | 720 |
| WO 2010139719 SEQ ID No. 10 | 45% | 42% | Rhodopseudomonas palent | 685 |
| WO 2010139719 SEQ ID No. 11 | 52% | 46% | Streptomyces coelicolor | 679 |

TABLE 19 percent sequence identity calculations using Blast and Huang and Miller algorithms for WT AacSHC enzyme relative to the WT ZmoSHC1 and WT ZmoSHC2 enzymes disclosed in Seitz (2012)

| Compared SHC sequences | % identity Blast maps | Percent identity as disclosed in Seitz (2012, thesis) |
|---|---|---|
| AacSHC/HAC vs ZmoSHC1 | 44% | 41% |
| AacSHC/HAC vs ZmoSHC2 | 39% | 37% |
| AacSHC/HAC vs AacSHC | 98% | ND |
| ZmoSHC1 vs ZmoSHC2 | 36% | 34% |
| AacSHC vs ZmoSHC2 | 39% | 37% |

TABLE 20

Nomenclature for Homofarnesol

| Compound | Abbreviation | Name and Structure |
|---|---|---|
| E,E-Homofarnesol | EEH | 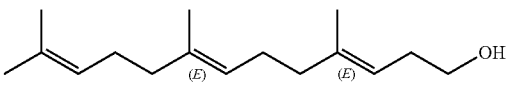 [SMILES: CC(C)=CCC/C(C)=C/CC/C(C)=C/CCO]<br>(3E,7E)-4,8,12-trimethyltrideca-3,7,11-trien-1-ol |
| E,Z-Homofarnesol | EZH | 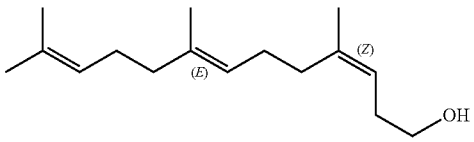 [SMILES: CC(C)=CCC/C(C)=C/CC/C(C)=C\CCO]<br>(3Z,7E)-4,8,12-trimethyltrideca-3,7,11-trien-1-ol |

TABLE 20-continued

Nomenclature for Homofarnesol

| Compound | Abbreviation | Name and Structure |
|---|---|---|
| Z,E-Homofarnesol | ZEH | (3E,7Z)-4,8,12-trimethyltrideca-3,7,11-trien-1-ol |
| Z,Z-Homofarnesol | ZZH | (3Z,7Z)-4,8,12-trimethyltrideca-3,7,11-trien-1-ol |

TABLE 21

Nomenclature for reaction products

| Compound | Description | Name and Structure |
|---|---|---|
| (I) | (−)-Ambrox | (3aR,5aS,9aS,9bR)-3a,6,6,9a-tetramethyldodecahydronaphtho[2,1-b]furan |
| (II) | Macrocycle | (7aS,11aS,Z)-5,8,8,11a-tetramethyl-2,3,6,7,7a,8,9,10,11,11a-decahydrobenzo[b]oxonine |
| (III) | 9b-epi-Ambrox | (3aR,5aS,9aS,9bS)-3a,6,6,9a-tetramethyldodecahydronaphtho[2,1-b]furan |

TABLE 21-continued

Nomenclature for reaction products

| Compound | Description | Name and Structure |
|---|---|---|
| (IV) | Escher et al (1990) | 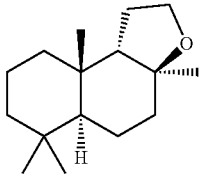 [SMILES: CC1(C)CCC[C@@]2(C)[C@H]1CC[C@]1(C)OCC[C@@H]21]<br>(3aS,5aS,9aS,9bS)-3a,6,6,9a-tetramethyldodeca-hydronaphtho[2,1-b]furan |

Escher S, Giersch W., Niclass Y, Bernardinello G and Ohloff G (1990). Configuration-odor relationships in 5β-Ambrox. Helv. Chim. Acta 73, 1935-1947.

BRIEF DESCRIPTIONS OF THE DRAWINGS

For a better understanding of the present disclosure, reference is made to the accompanying drawings in which:

FIGS. 1-4 show the sequence alignment of selected Aac-SHC Derivatives relative to AacSHC SEQ ID No. 1. In descending order of appearance, the SEQ ID Nos. of FIG. 1 are: SEQ ID No. 1, SEQ ID No. 29, SEQ ID No. 27, SEQ ID No. 21, SEQ ID No. 19, SEQ ID No. 9, SEQ ID No. 23, SEQ ID No. 33, SEQ ID No. 35, SEQ ID No. 37 and SEQ ID No. 39;

Figure 11:
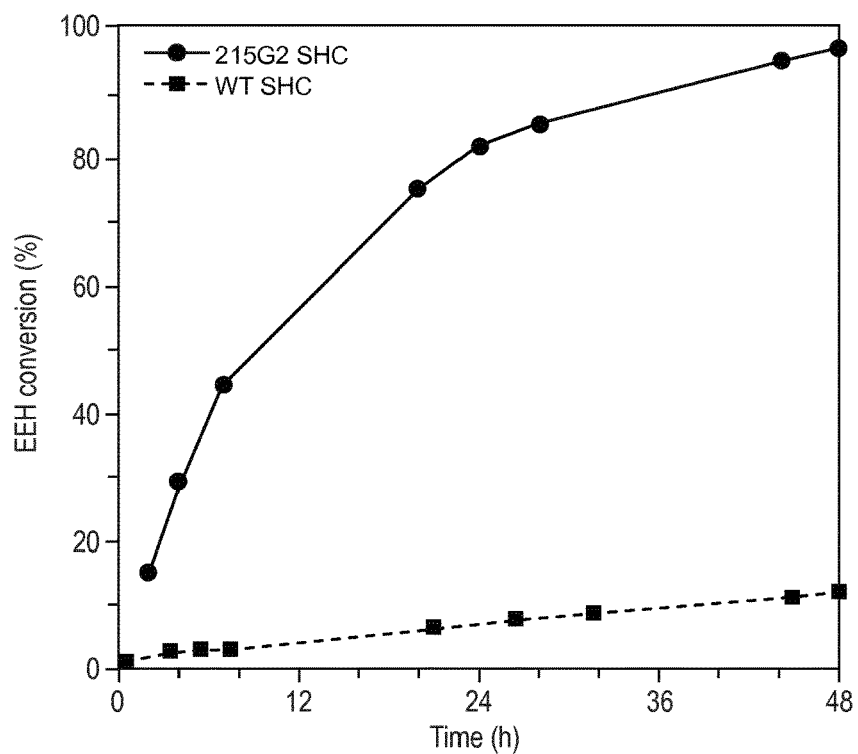
Figure 12:
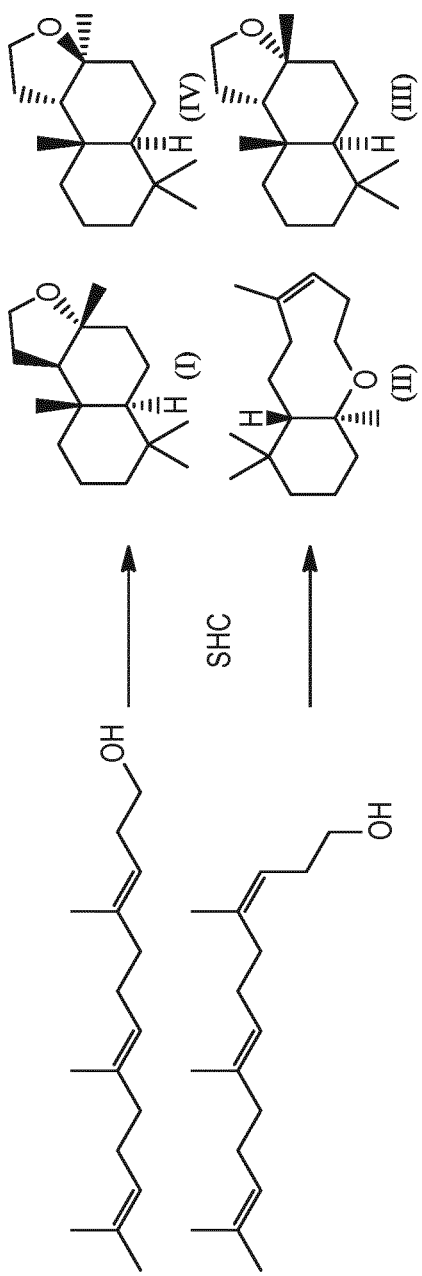
Figure 13:
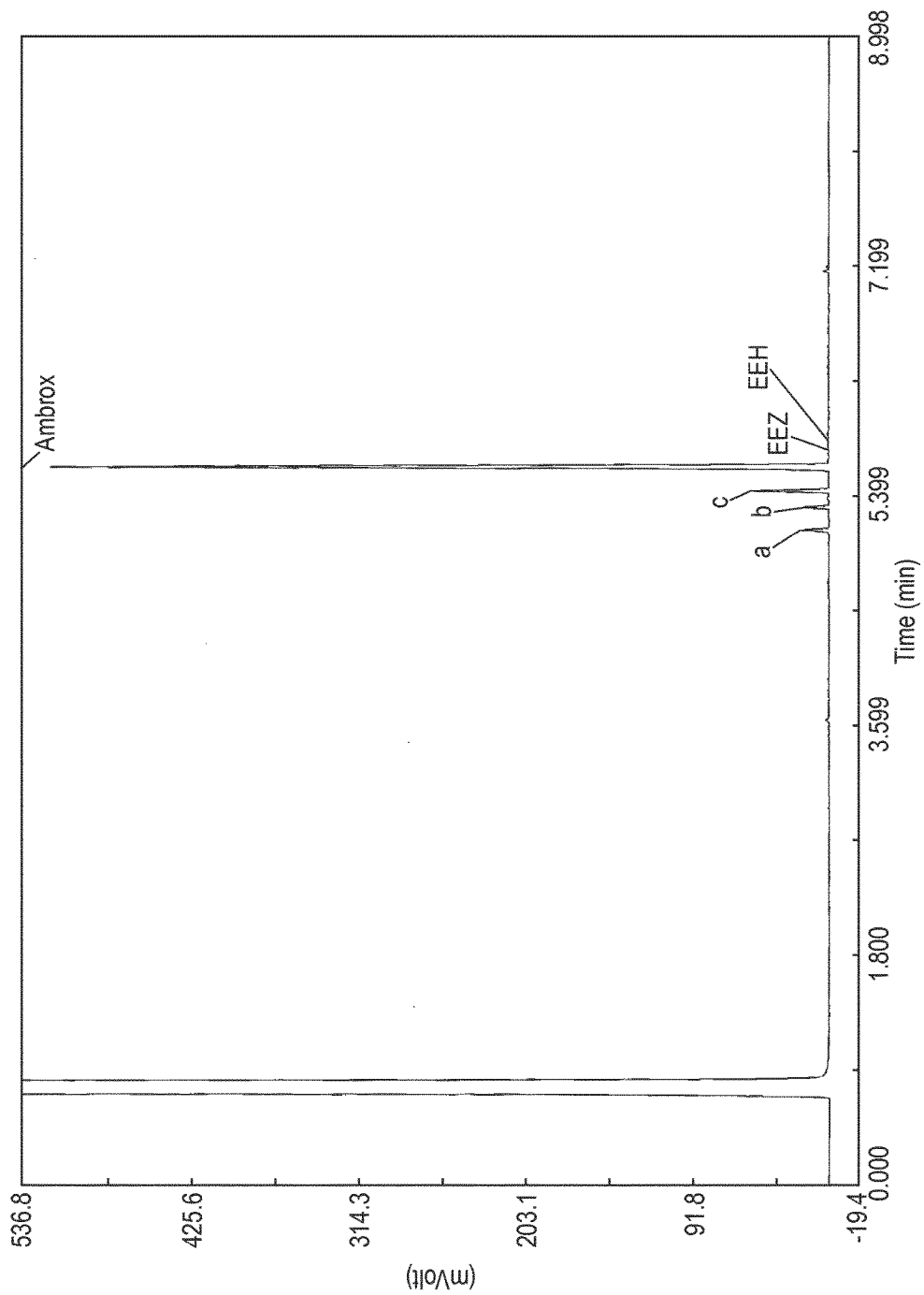
Figure 14:
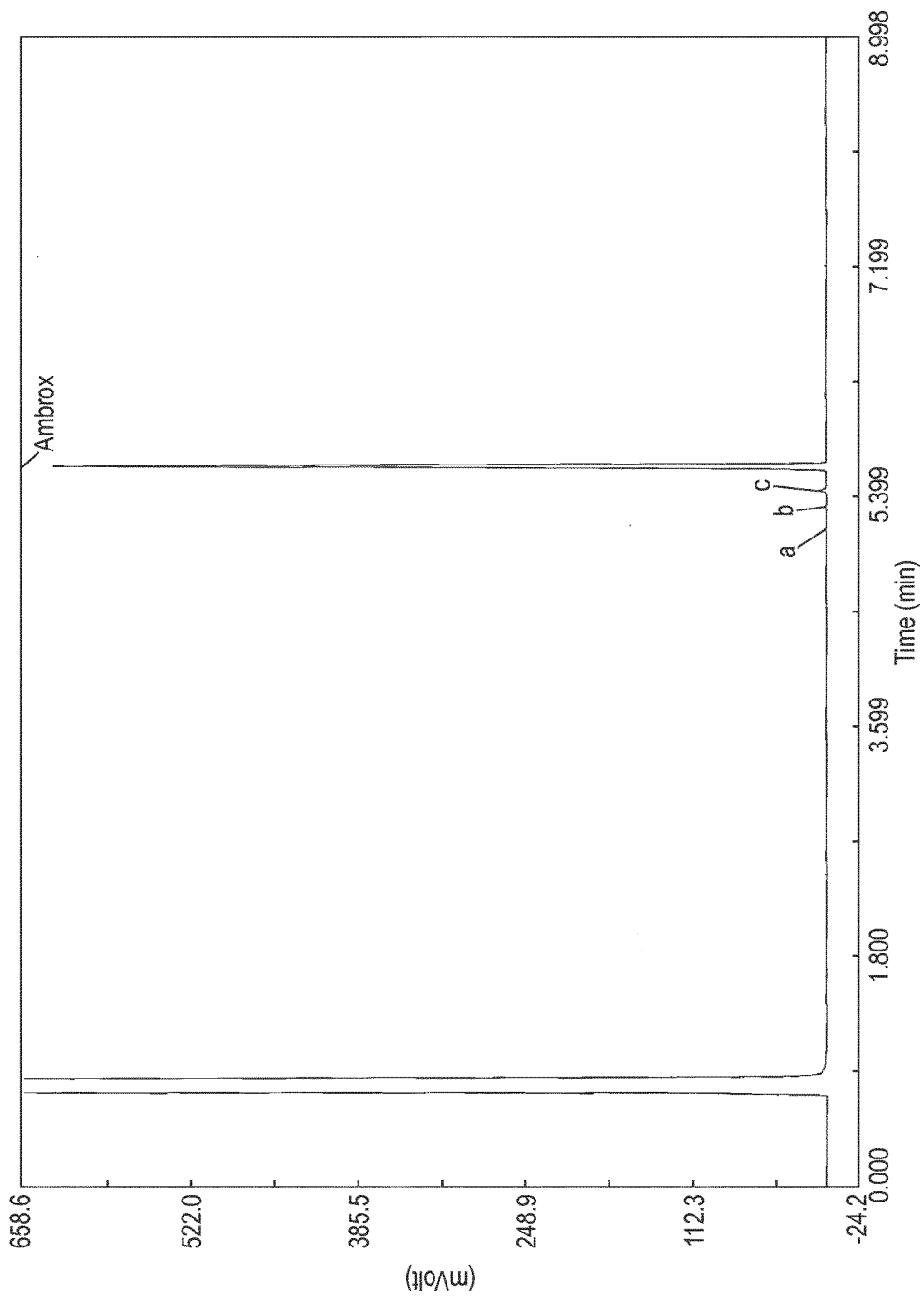
Figure 15:
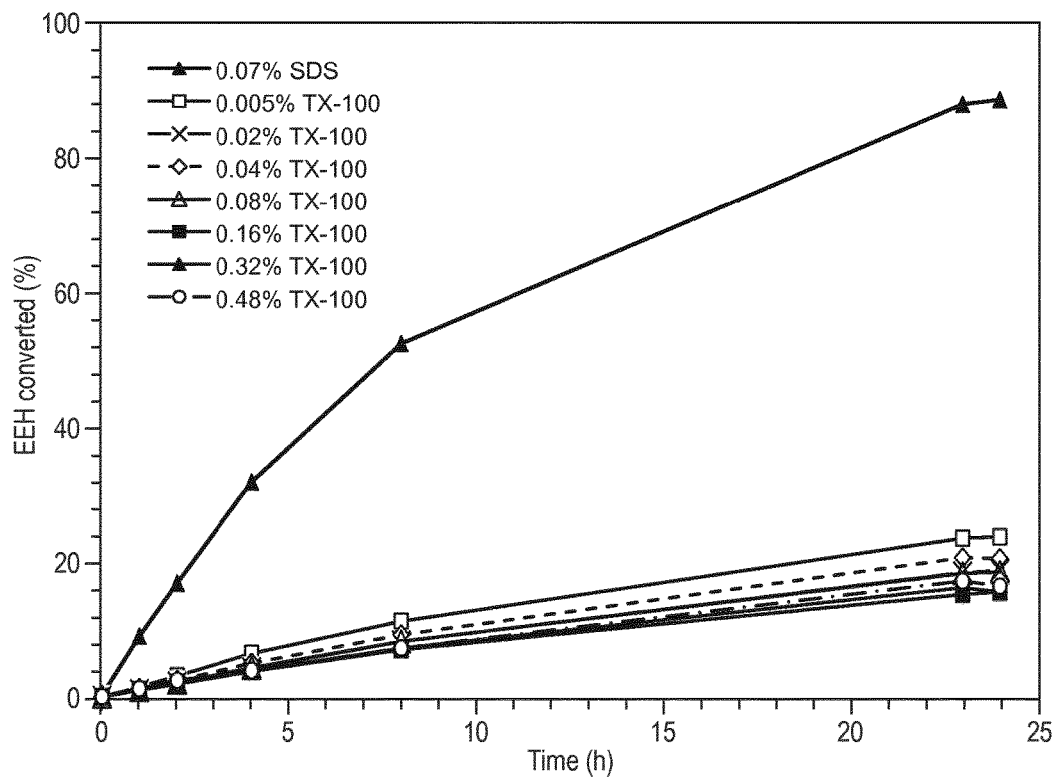
Figure 16:
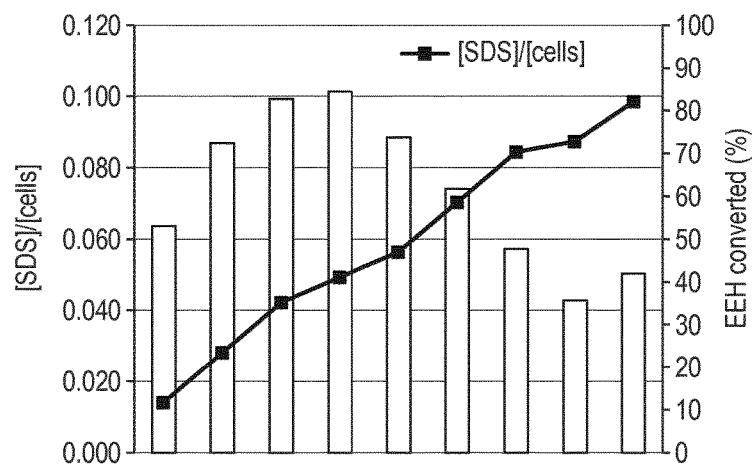
Figure 17:
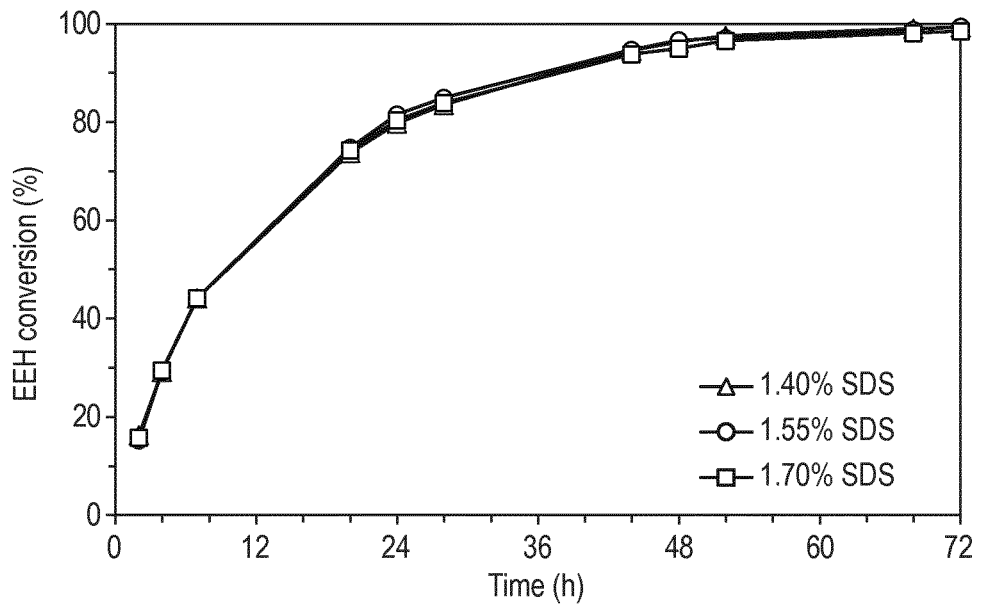
Figure 18:
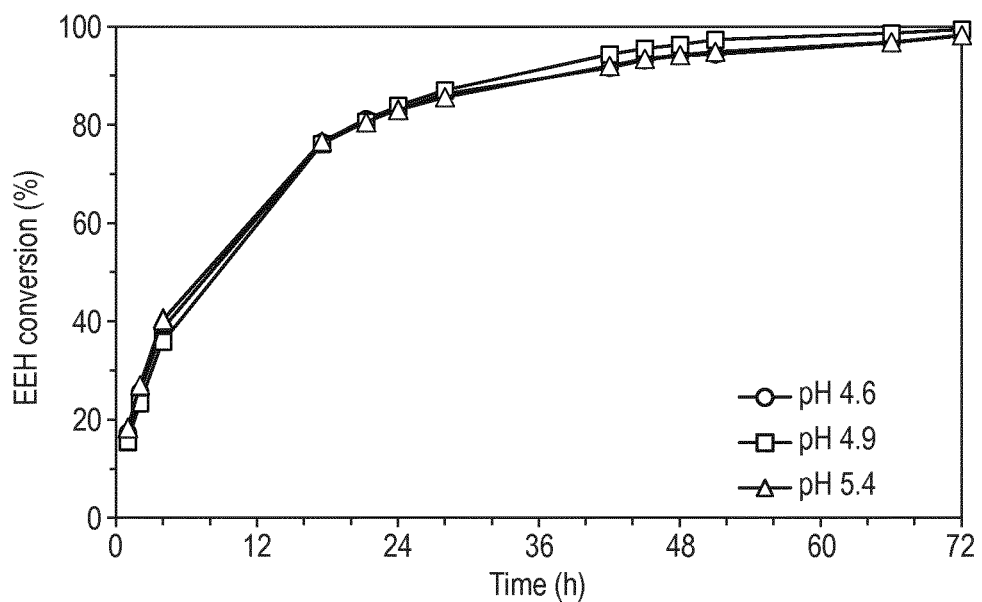
Figure 19:
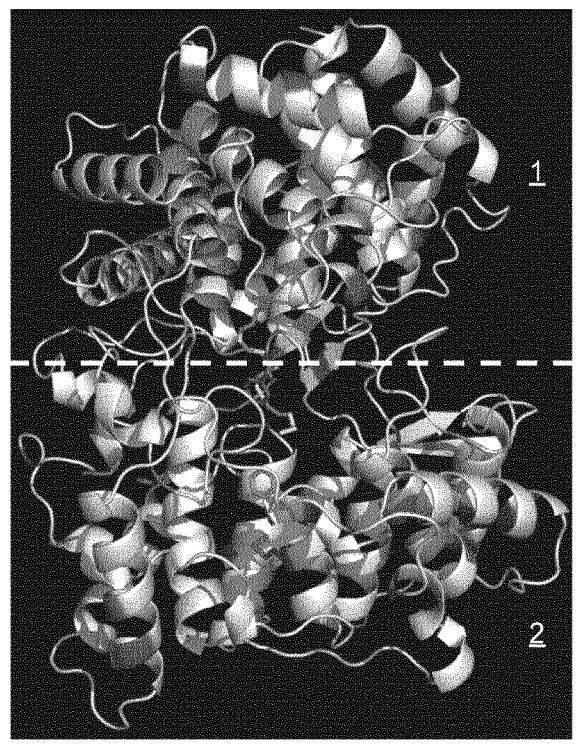
Figure 20:
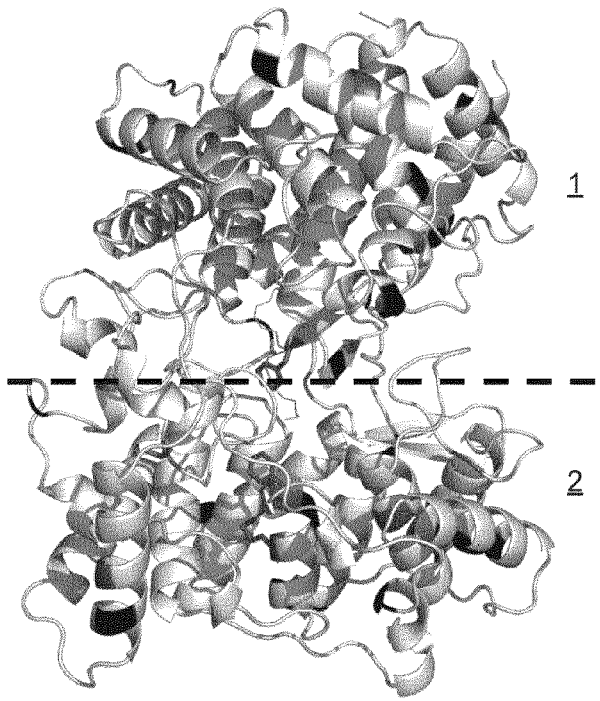
Figure 21:
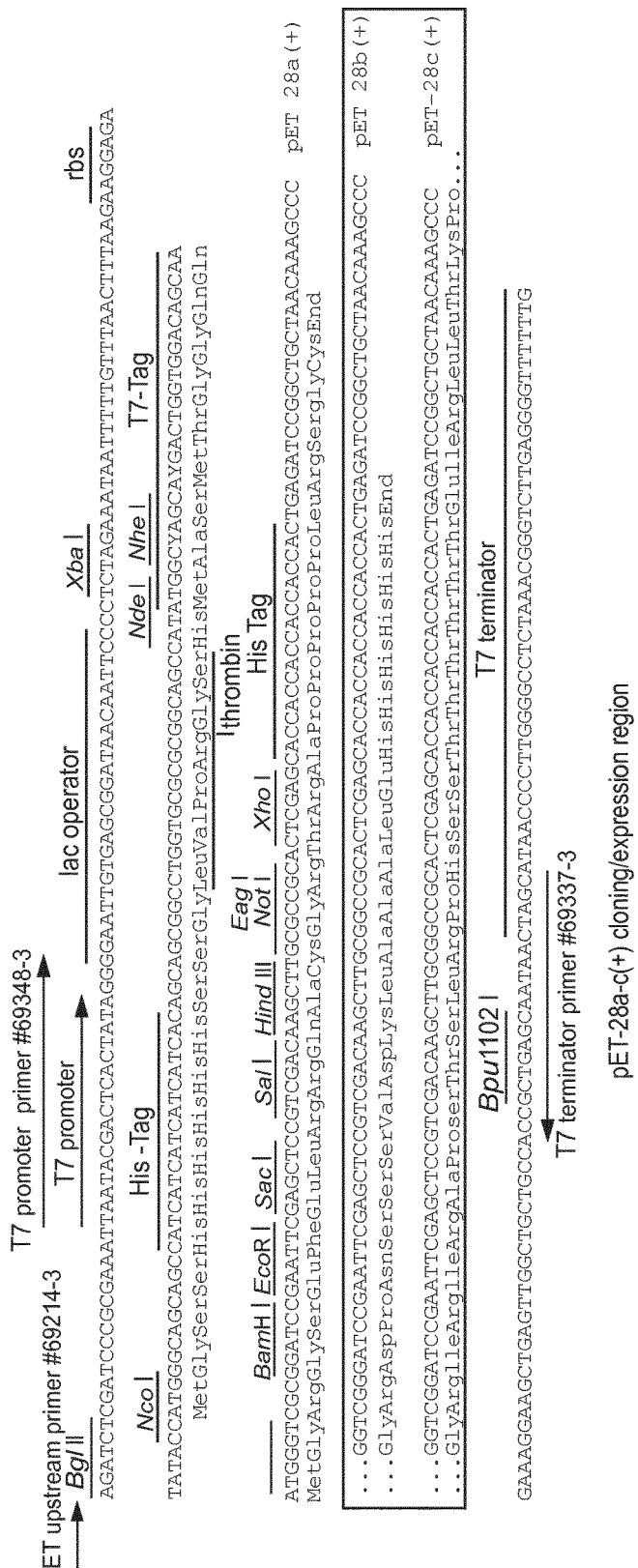

FIG. 11 shows the observed E,E-homofarnesol conversion to Ambrox by a SHC/HAC derivative (215G2 SHC) and WT AacSHC. At 7 hours of reaction (estimation of initial reaction velocity) conversion with variant 215G2 SHC was 13-fold higher than that achieved with wild-type SHC. At 48 hours of reaction conversion with the variant was about 8-fold that of the wild-type enzyme;

FIG. 12 shows the reaction products produced (Ambrox and product (IV)) when EEH is used as a starting material (for bioconversion with WT SHC and/or a SHC/HAC Derivative); and the reaction products produced ((−)-Ambrox (I) and products (II), (IV) and (III) (see Table 21) when EE:EZ is used as a starting material); for ease of reference, compounds I-IV can be identified as follows:

I: (3aR,5aS,9aS,9bR)-3a,6,6,9a-tetramethyldodecahydronaphtho[2,1-b]furan (−)-Ambrox II: (7aS, 11aS,Z)-5,8,8,11a-tetramethyl-2,3,6,7,7a,8,9,10,11,11a-decahydrobenzo[b]oxonine IV: (3aS,5aS,9aS,9bS)-3a,6,6,9a-tetramethyldodecahydronaphtho[2,1-b]furan III: (3aRS,5aSR,9aSR,9bSR)-3a,6,6,9a-tetramethyldodecahydronaphtho[2, 1-b]furan 9-epi-Ambrox FIG. 13 shows a GC-analysis of the reaction products for Ambrox and products (II), (IV) and (III) in Table 25;

FIG. 14 shows GC-analysis of the reaction products for Ambrox and products (II), (IV) and (III) in Table 25;

FIG. 15 provides comparative data for 215G2SHC variant activity in the whole cell bioconversion assay in the presence of either Triton X-100 or SDS;

FIG. 16 shows the percent converted EEH for different SDS/cell ratios;

FIG. 17 shows % EEH conversion in the standard bioconversion reaction (as described in Example 7) for three different SDS concentrations;

FIG. 18 shows % EEH conversion in the standard bioconversion reaction (as described in Example 7) for three different pH values;

FIG. 19 shows the location of the mutations identified in SHC/HAC variants 101A10, 111C8 and 215G2 on the SHC Crystal Structure (in colour): red for variant 215G2; purple (wine red) for variant 101A10 and green for variant 111C8. For the amino acids identified at as being responsible for the increased activity, the side-chains are highlighted in yellow in the co-crystallized substrate analog. Other mutations for identified variants with no improved activity are marked in blue. It is noted that blue mutations are spread about half-half (i.e. 50:50) over the 2 domains of the enzyme, whereas the beneficial AacSHC mutations which were identified are located mostly (apart from one) in domain 2. The only exception is the mutation F601Y which is in the vicinity of the active site;

FIG. 20 shows the following mutations (in black and white): mutations having no beneficial effect on SHC/HAC activity are shown in black, they are spread over the 2 domains of the SHC enzyme. In grey are shown the mutations identified in SHC variants (101A10, 111C8 and 215G2) showing improved SHC/HAC activity, they are located with only one exception in domain 2 of the SHC enzyme. The side chain of the mutations contributing to the improved activity of the variants are highlighted;

FIG. 21 shows the cloning and expression region of plasmid pET-28a(+); The SEQ ID Nos for the sequences in FIG. 21 are as follows:
pET 28a (nucleotide sequence): SEQ ID No. 179;
pET 28a (amino acid sequence): SEQ ID No. 180;
pET 28b (nucleotide sequence): SEQ ID No. 181;
pET 28b (amino acid sequence): SEQ ID No. 182;
pET 28c (nucleotide sequence): SEQ ID No. 183; and
pET 28c (amino acid sequence): SEQ ID No. 184.

Figure 22:
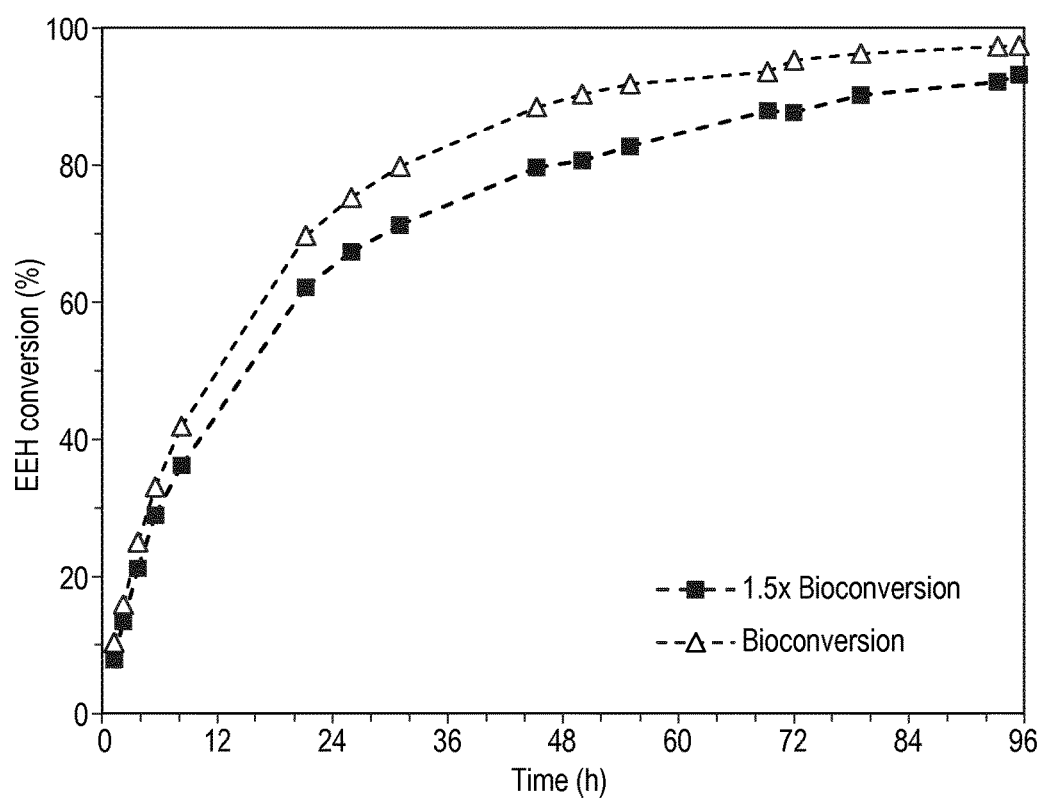
Figure 23:
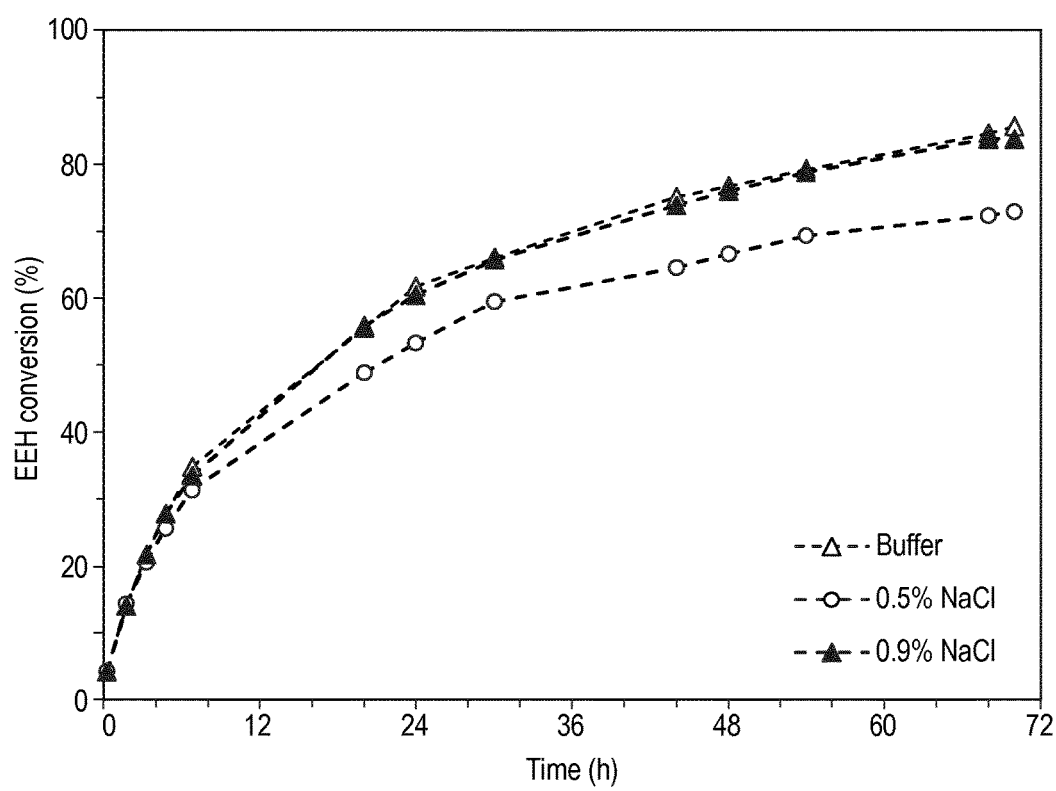
Figure 24:
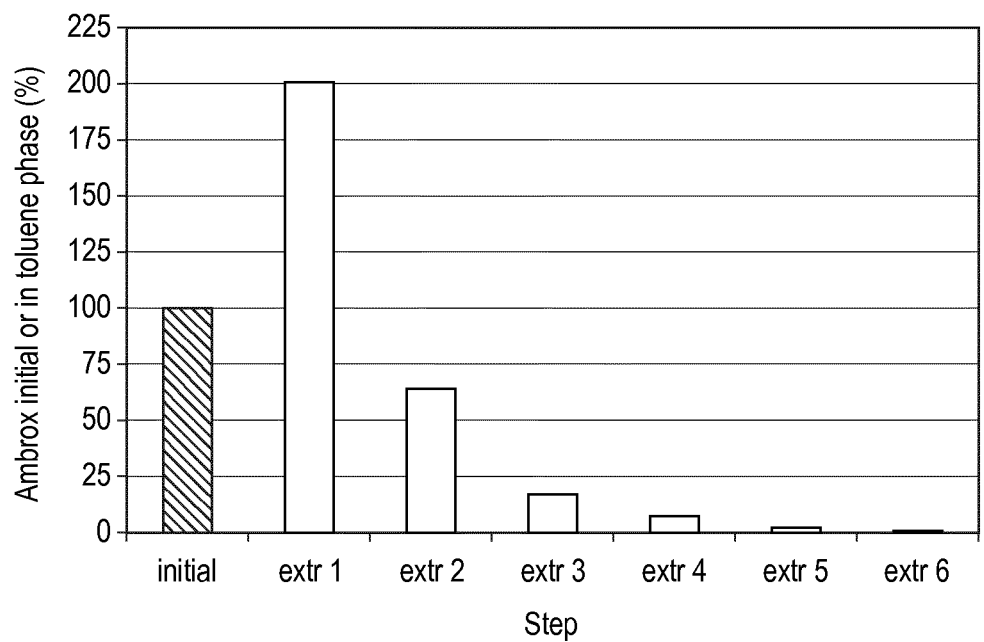
Figure 25:
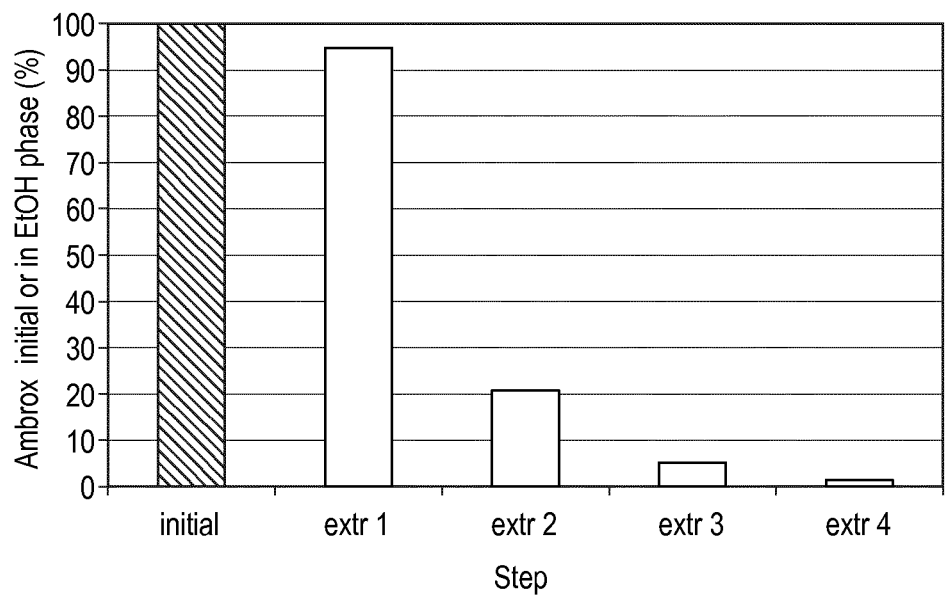

FIG. 22 shows the volumetric productivity of a 1.5× concentrated EEH bioconversion reaction containing 375 g/l of cells, 188 g/l EEH, 2.33% SDS as compared with the volumetric productivity of a regular bioconversion which was run in parallel at 125 g/l EEH, 250 g/l cells, 1.55% SDS (Example 7);

FIG. 23 shows a regular bioconversion (125 g/l EEH, 250 g/l cells, 1.55% SDS) which was run as described in Example 7 but replacing the citric acid buffer pH 5.4 by either 0.5% or 0.9% NaCl, all other reaction parameters being unchanged. A bioconversion in citric acid buffer was run in parallel as a control;

FIG. 24 shows the evolution of the solid phase extraction of (−)-Ambrox over the toluene washes as % of the (−)-Ambrox quantity initially present in 200 ml whole reaction broth (due to the volume ratio broth/toluene, % in the first extract goes over 100%); and FIG. 25 shows the evolution of the solid phase extraction of (−)-Ambrox over the ethanol washes as a percent of the (−)-Ambrox quantity intially present. After 4 washes (total 640 ml EtOH, i.e. 3.2× the initial whole reaction broth volume or 8× the volume of the solid phase), about 99% of (−)-Ambrox initially present in the reaction broth was recovered.

EXAMPLES

For the avoidance of doubt, all reference to WT SHC and SHC variants are references to WT AacSHC (SEQ ID No. 1) and variants thereof (eg. as listed in Tables 23 and/or Table 24).

Example 1

Biocatalyst Production
Methods 1
SHC Plasmid Preparation

Figure 5:
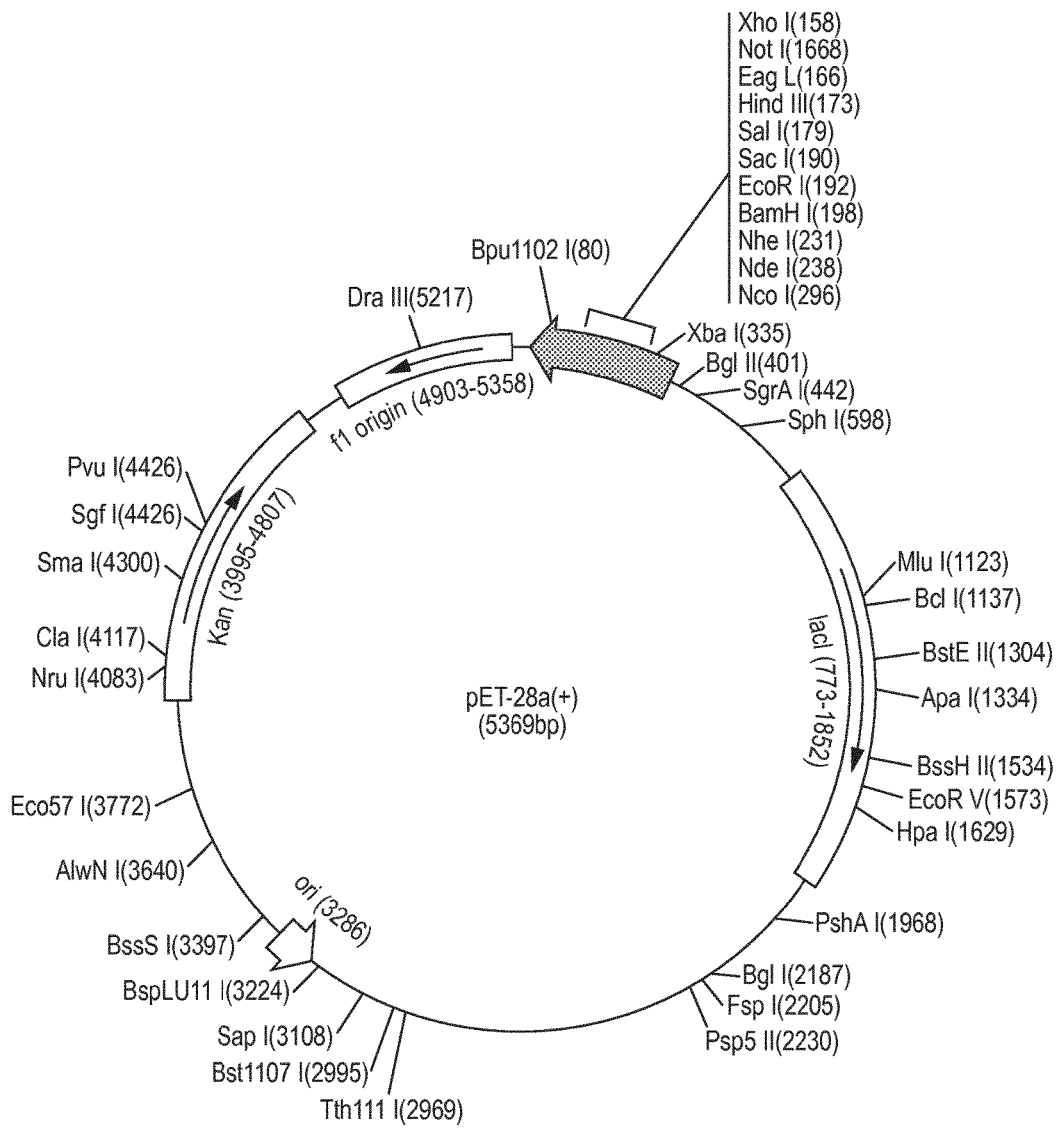
FIG. 5 shows a plasmid map.

The gene encoding *Alicyclobacillus acidocaldarius* squalene hopene cyclase (AacSHC) was inserted into plasmid pET-28a(+), where it is under the control of an IPTG inducible T7-promotor for protein production in Escherichia coli (see FIGS. 5 and 21). The plasmid was transformed into *E. coli* strain BL21(DE3) using a standard heat-shock transformation protocol.

Erlenmeyer Flask Cultures

For protein production were used either complex (LB) or minimal media. M9 is one example of minimal media, which were successfully used.

Media Preparation

The minimal medium chosen as default was prepared as follows for 350 ml culture: to 35 ml citric acid/phosphate stock (133 g/l KH$_2$PO$_4$, 40 g/l (NH$_4$)$_2$HPO$_4$, 17 g/l citric acid.H$_2$O with pH adjusted to 6.3) was added 307 ml H$_2$O, the pH adjusted to 6.8 with 32% NaOH as required. After autoclaving 0.850 ml 50% MgSO$_4$, 0.035 ml trace elements solution (composition in next section) solution, 0.035 ml Thiamin solution and 7 ml 20% glucose were added.

SHC Biocatalyst Production (Biocatalyst Production)

Small scale biocatalyst production (wild-type SHC or SHC variants), 350 ml culture (medium supplemented with 50 μg/ml kanamycin) were inoculated from a preculture of the *E. coli* strain BL21(DE3) containing the SHC production plasmid. Cells were grown to an optical density of approximately 0.5 (OD$_{650nm}$) at 37° C. with constant agitation (250 rpm).

Protein production was then induced by the addition of IPTG to a concentration of 300 μM followed by incubation for a further 5-6 hours with constant shaking. The resulting biomass was finally collected by centrifugation, washed with 50 mM Tris-HCl buffer pH 7.5. The cells were stored as pellets at 4° C. or −20° C. until further use. In general 2.5 to 4 grams of cells (wet weight) were obtained from 1 liter of culture, independently of the medium used.

Fermentations were prepared and run in 750 ml InforsHT reactors. To the fermentation vessel was added 168 ml deionized water. The reaction vessel was equipped with all required probes (pO$_2$, pH, sampling, antifoam), C+N feed and sodium hydroxide bottles and autoclaved. After autoclaving is added to the reactor
  20 ml 10× phosphate/citric acid buffer
  14 ml 50% glucose
  0.53 ml MgSO$_4$ solution
  2 ml (NH$_4$)$_2$SO$_4$ solution
  0.020 ml trace elements solution
  0.400 ml thiamine solution
  0.200 ml kanamycin stock The running parameters were set are as follows: pH=6.95, pO$_2$=40%, T=30° C., Stirring at 300 rpm. Cascade: rpm setpoint at 300, min 300, max 1000, flow 1/min set point 0.1, min 0, max 0.6. Antifoam control: 1:9.

The fermenter was inoculated from a seed culture to an OD$_{650nm}$ of 0.4-0.5. This seed culture was grown in LB medium (+Kanamycin) at 37° C., 220 rpm for 8 h. The fermentation was run first in batch mode for 11.5 h, where after was started the C+N feed with a feed solution (sterilized glucose solution (143 ml H$_2$O+35 g glucose) to which had been added after sterilization: 17.5 ml (NH$_4$)$_2$SO$_4$ solution, 1.8 ml MgSO$_4$ solution, 0.018 ml trace elements solution, 0.360 ml Thiamine solution, 0.180 ml kanamycin stock. The feed was run at a constant flow rate of approx. 4.2 ml/h. Glucose and NH$_4^+$ measurements were done externally to evaluate availability of the C- and N-sources in the culture. Usually glucose levels stay very low.

Cultures were grown for a total of approx. 25 hours, where they reached typically and OD$_{650nm}$ of 40-45. SHC production was then started by adding IPTG to a concentration of approx. 1 mM in the fermenter (as IPTG pulse or over a period of 3-4 hours using an infusion syringe), setting the temperature to 40° C. and pO$_2$ to 20%. Induction of SHC production lasted for 16 h at 40° C. At the end of induction the cells were collected by centrifugation, washed with 0.1M citric acid/sodium citrate buffer pH 5.4 and stored as pellets at 4° C. or −20° C. until further use.

Results 1a

In general, with all other conditions unchanged the specific activity of the produced biocatalyst was higher when a minimal medium was used compared with a complex medium. Induction was carried out successfully at 30 or 37° C. It was noted that when the induction was done at 40-43° C., a biocatalyst of higher specific activity was obtained.

Results 1b

The following Table 22 shows for 2 examples the culture volume, optical density and amount of cells both at induction start and induction end as well as the amount of biomass collected (wet weight).

TABLE 22

|  | Volume at induction start (ml) | OD$_{650\,nm}$ Induction start | cells calculated (g) | Volume at Induction end (ml) | OD$_{650\,nm}$ Induction end | cells collected (g) |
|---|---|---|---|---|---|---|
| Example 1 | 273 | 40 | 10.9 | 342 | 55 | 28 |
| Example 2 | 272 | 44 | 12.0 | 341 | 57 | 23 |

OD$_{650\,nm}$ at inoculation: 0.45 (Example 1) and 0.40 (Example 2). Starting volumes: 205 ml.

Example 2

Preparation of SHC Variants and Activity Screening
Methods 2

For the avoidance of doubt, EE corresponds to (3E,7E); EZ mixture corresponds to (3Z,7E); ZE corresponds to (7Z,3E); ZZ corresponds to (7Z,3Z); and EEH corresponds to (3E,7E).

An enzyme evolution program was carried out using the wild-type (WT) *Alicyclobacillus acidocaldarius* SHC (Aac-SHC) gene as a template (GenBank M73834, Swissprot P33247). A library of about 10500 SHC variants was produced and screened for variants showing increased EEH cyclization ability. Screening was run in reactions in citric acid buffer pH 6.0 (0.150 ml ) containing 4 g/l EEH and 0.050% SDS, at 55° C. and under constant agitation.

With hits selected for validation a standard test was run in citric acid buffer pH 6.0 containing 4 g/l EEH 0.050% SDS, cells that had expressed the SHC variants to an OD$_{600nm}$ of 10.0 in. The final volume was 1 ml, reactions were incubated at 55° C. and vigorously stirred on a magnetic stirrer. Reaction sampling over time allowed investigating activity profiles (EEH conversion to (–)-Ambrox) and as determined by gas chromatography analysis (see analytic methods below).

From this validation round, 3 variants with improved EEH cyclization activity (101A10, 111C8 and 215G2) were obtained and then a total of 8 mutations were identified on these 3 variants. A mutations study was then run to identify which of these mutations were beneficial with regard to EEH cyclization to Ambrox. In addition to this AacSHC derivative, another AacSHC variant was constructed, which contained all of the identified beneficial mutations (SHC33 as outlined in Table 23 below). The screening conditions were: 4 g/l EEH cells to an OD$_{650nm}$ of 10.0, SDS to 0.05% and 0.1% (2 concentrations) and the reactions were run at 55° C. under constant agitation.
Results 2a Results 2b Of the three selected mutations (101A10, 111C8 and 215G2), 215G2 showed the best activity.

Example 3

Optimized Reaction Conditions With SHC Variants
Reaction Parameters Investigated: Temperature, SDS Concentration and pH
Methods 3

The reaction conditions for the SHC variants derivatives identified in Table 23 were individually optimized with regard to temperature, pH and SDS concentration. To this end, the *E. coli* cells were transformed with the plasmid for the production of the individual variants which were cultivated in Erlenmeyer flasks and SHC production induced as described above. In this way it was ensured that all cultures contained same or very similar SHC quantities. Cells were collected by centrifugation, washed with 0.1M citric acid buffer (pH 6.0) and stored at –20° C. until further used.
Results 3

The result of this optimization study is summarized in the below table. An optimization round was also carried out with wild-type SHC.

The following Table 24 shows optimal reaction conditions for the wild-type and each of the variants considered for the characterization of each SHC/HAC Derivative enzyme.

TABLE 24

Optimal reaction conditions for SHC Derivative enzymes

| SHC | Temperature (° C.) | pH | [SDS] (weight/weight %) |
|---|---|---|---|
| WT | 55 (45-60) | 6.0 (5.6-6.2) | 0.030 (0.010-0.075) |
| 101A10 | 40 (36-50) | 6.4 (5.4-7.0) | 0.050 (0.010-0.10) |
| 111C8 | 40 (36-50) | 6.0 (5.6-6.6) | 0.070 (0.010-0.090) |
| 215G2 | 35 (32-50) | 5.4 (5.0-6.2) | 0.060 (0.010-0.10) |
| SHC3 | 37 (34-50) | 5.8 (5.4-6.4) | 0.020 (0.010-0.060) |
| SHC10 | 42 (34-55) | 6.0 (5.4-6.4) | 0.060 (0.030-0.10) |
| SHC26 | 32 (30-50) | 5.4 (5.4-6.2) | 0.060 (0.020-0.10) |
| SHC30 | 35 (34-50) | 6.2 (5.4-7.0) | 0.0050 (0.0025-0.070) |
| SHC31 | 35 (30-50) | 5.6 (5.4-6.4) | 0.050 (0.010-0.10) |

TABLE 23

Mutations in evaluated AacSHC Derivative enzymes

| SHC | T77A | I92V | F129L | M132R | A224V | I432T | Q579H | F601Y |
|---|---|---|---|---|---|---|---|---|
| 101A10 |  |  |  |  |  |  | X | X |
| 111C8 | X | X | X |  |  |  |  |  |
| 215G2 |  |  |  | X | X | X |  |  |
| SHC3 |  |  |  |  |  |  |  | X |
| SHC10 |  | X |  |  |  |  |  |  |
| SHC26 |  |  |  | X |  | X |  |  |
| SHC30 |  | X |  |  |  |  |  | X |
| SHC31 |  | X | X |  | X |  |  |  |
| SHC32 |  |  | X |  | X |  | X |  |
| SHC33 |  | X | X |  | X |  | X |  |

TABLE 24-continued

Optimal reaction conditions for SHC Derivative enzymes

| SHC | Temperature (° C.) | pH | [SDS] (weight/weight %) |
|---|---|---|---|
| SHC32 | 35 (34-50) | 5.6 (5.4-6.4) | 0.050 (0.010-0.10) |
| SHC33 | 35 (32-50) | 5.2 (4.8-6.4) | 0.030 (0.0050-0.10) |

Discussion 3

Example 3 shows the differences noted in reaction conditions for the SHC Derivatives compared to WT SHC. Significant deviation from the wild-type SHC for optimal temperature, pH and SDS concentration were observed with the SHC variants. Only a small number of mutations have a significant effect on the optimal bioconversion reaction conditions. For the determination of individual reaction conditions with the selected SHC variants, reactions were run at a substrate loading of 4 g/l of EEH and cells that had produced the wild-type or SHC derivatives at an optical density $OD_{650nm}$ of 10.0.

Temperature

The data in Table 24 demonstrate the surprising finding that whilst the WT SHC enzyme has optimal activity at 55° C. (in the range of 45-60° C.), a number of the SHC Derivatives have optimal activity at 35° C. (34-50° C.). The application of the SHC Derivatives of the present disclosure in methods for preparing (−)-Ambrox from E,E-homofarnesol at lower reaction temperatures has significant cost advantages for the production of (−)-Ambrox at an industrial scale.

Solubilizing Agent

SDS was selected and identified from a long list of possible solubilising agents which were not useful in the bioconversion reaction (see Example 14 for more information) SDS is better than eg. Triton X-100 in terms of reaction velocity and yield (both in the test at 4 g/l of EEH and when 125 g/l EEH is used as provided in Example 7).

Example 4

SHC Variant Activity Testing in Comparison to the WT SHC Enzyme Under Standard Conditions Methods 4

For comparing the relative activity of the biocatalysts, the production of the variants (as set out in Table 24) is described as follows. The *E. coli* cells were transformed with a plasmid for the production of one of the SHC variants and the *E. coli* cells were then cultivated in LB medium at 37° C. and 280rpm, grown to an $OD_{650nm}$ of 0.50 and enzyme production induced by the addition of IPTG. Induction lasted for 5.5 hours at 37° C., 280rpm. Cells were collected by centrifugation, washed with 0.1M citric acid pH 6.0 and stored at −20° C. until further use. When comparing the SHC variant activities (see FIG. 6), a sample of the reaction mixture was loaded onto an SDS-PAGE gel for analyzing the SHC content of the reactions. This analysis confirmed that all reactions contained identical amounts of SHC enzyme.

Results 4a

Figure 6:
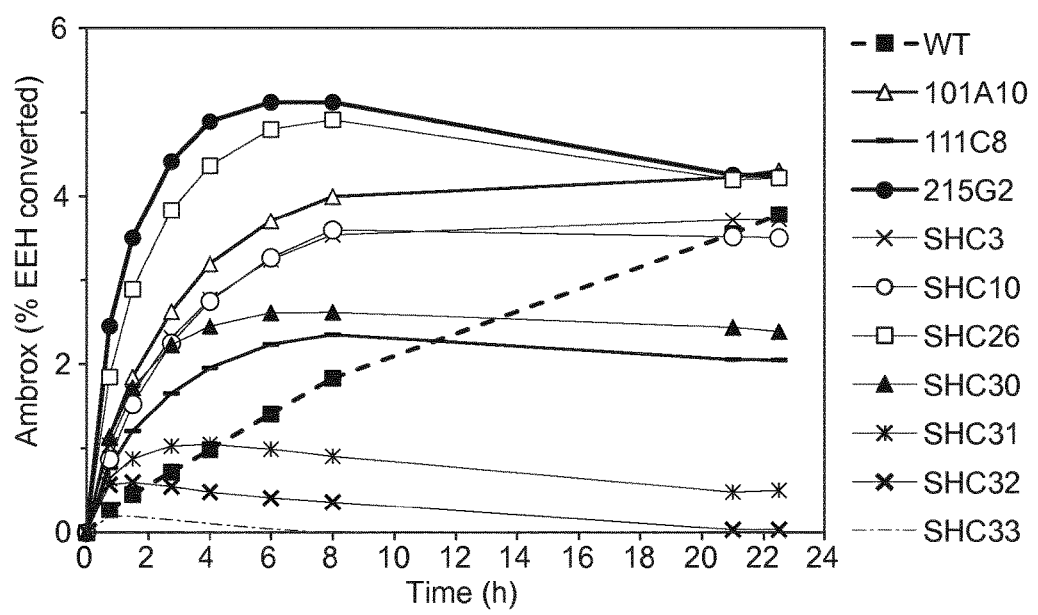
FIG. 6 shows the relative HAC activities of the wild-type AacSHC and AacSHC Derivatives as set out in Table 24 under standard conditions (pH6.0, 55° C., 0.050% SDS, cells to $OD_{650nm}$ of 10)

FIG. 6 shows the relative activities of the wild-type and SHC variants under standard conditions (pH6.0, 55° C., 0.050% SDS, cells to $OD_{650nm}$ of 10). It was also noted that wild-type SHC and at least the tested SHC variants according to the Examples of the present disclosure are solvent tolerant. This means that selected water nonmiscible solvents (up to almost 100%) may be added to the bioconversion reaction.

Results 4b

Using the 215G2 SHC variant, no noteable effect on the activity of this variant was observed when NaCl is added to the reaction (concentrations tested 5 to 100 mM (only)). In addition, NaCl addition up to 100 mM or up to 154 mM (0.9% NaCl), showed no negative effect on SHC activity in variant 215G2. These finding suggest that if the bioconversion reaction is carried out in a physiological solution of NaCl (0.9%) or the like and the pH is maintained at an appropriate value (eg. about 5.4 (5.2-5.6)), then the bioconversion reaction may be carried out in the absence of a buffer but in the presence of a physiological NaCl solution or the like.

Discussion 4

FIG. 6 illustrates the ranking of the activity of the selected variants and wild-type SHC enzymes in terms of EEH conversion to (−)-Ambrox.

Example 5

WT SHC and SHC Derivative Activity Profiles

Methods 5

The activity test was run in 0.1 M citric acid buffer in 5 ml volume under constant shaking at 900 rpm on a Heidolph Synthesis 1 apparatus. The pH of the buffer used, the temperature at which the reaction was run and the concentration of SDS (sodium dodecyl sulfate) in the reaction was depending on the SHC variant which was used (wild-type or variant). The optimal conditions for each of the variants tested are summarized in Table 24 above.

A Homofarnesol starting material of 96% purity and a homofarnesol substrate with an EEH:EZH ratio of 87:13 was used.

For the avoidance of doubt, an EE:EZ mixture is a mixture of ((3E,7E) and (3Z,7E) isomers.

Results 5

Homofarnesol Used: EEH:EZH 87:13, Purity (NMR): 96%.

Figure 7A:
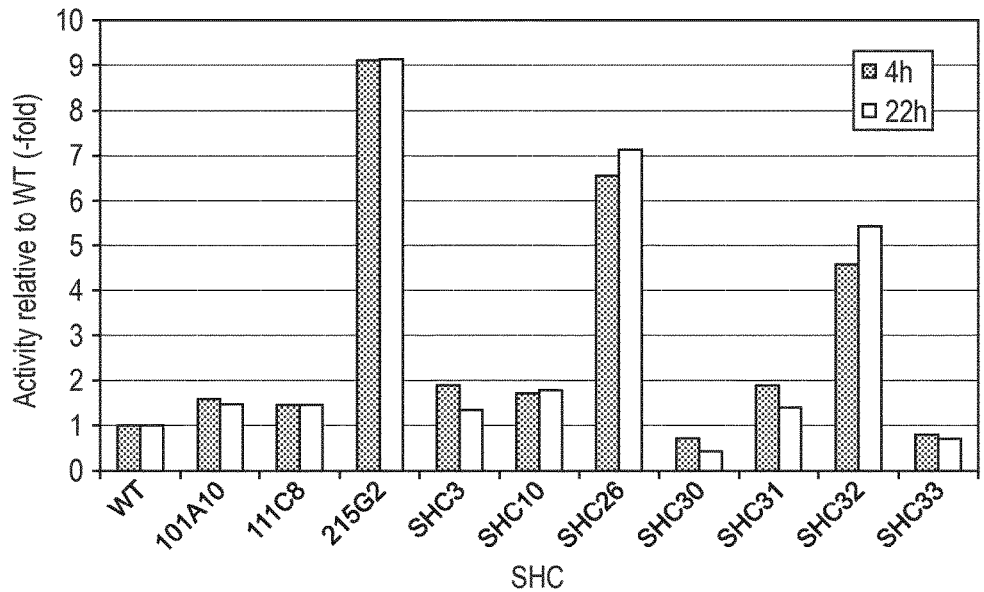
FIG. 7a shows the HAC activity profiles of the AacSHC Derivatives relative to WTAacSHC using homofarnesol quality EEH:EZH 87:13 and at a 96% purity of homofarnesol (as determined using NMR)
Figure 7B:
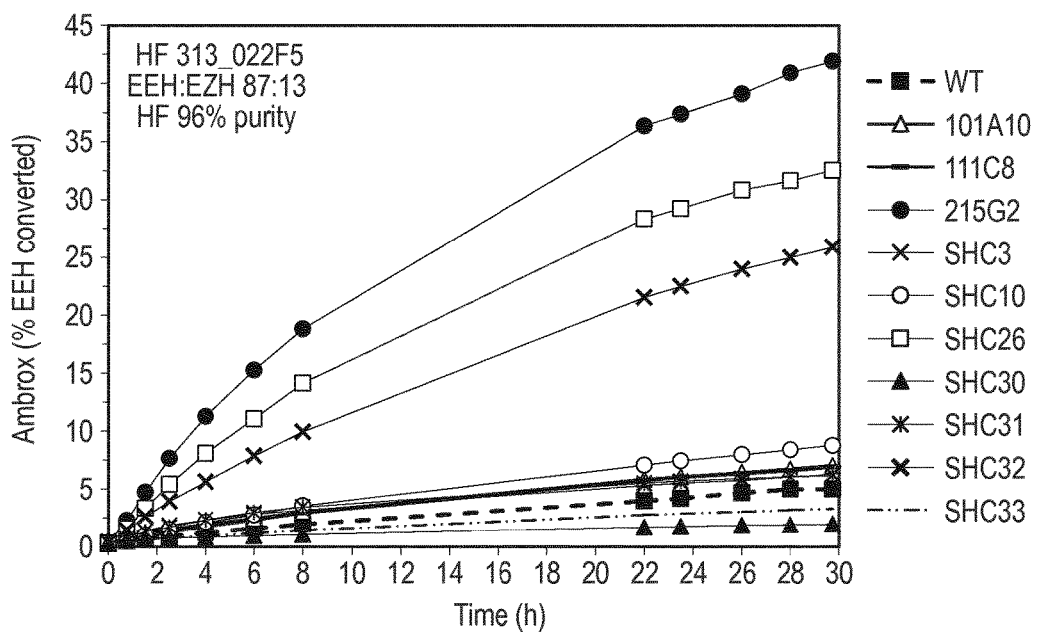
FIG. 7b shows the relative improvement of the AacSHC Derivatives relative to WT SHC (4 h (initial velocity) and yield at 22 h) using homofarnesol quality EEH:EZH 87:13 and at a 96% purity of homofarnesol (as determined using NMR)

The results of the standard test run under optimized conditions are shown in FIG. 7B (activity profiles of the SHC derivatives relative to WT SHC) and FIG. 7A which shows the relative activity improvement of the SHC Derivatives relative to WT SHC (4 h (initial velocity) and yield at 22 h).

Homofarnesol Used: EEH:EZH 92:08, Purity (NMR): 100%

Figure 8A:
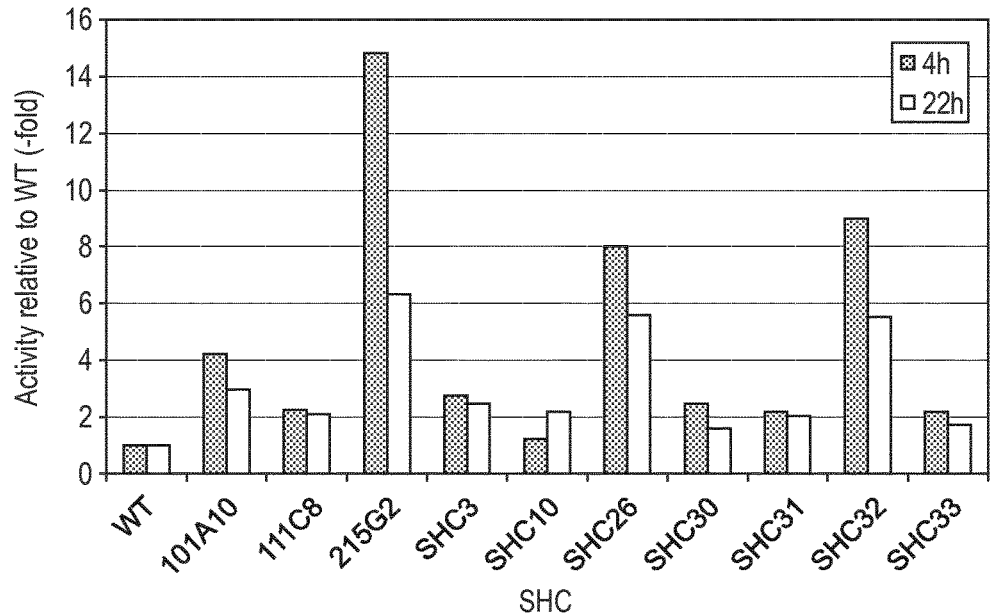
FIG. 8a shows the HAC activity profiles of the AacSHC Derivatives relative to WTAacSHC using homofarnesol quality EEH:EZH 92:08 and at a 100% purity of homofarnesol (as determined using NMR)
Figure 8B:
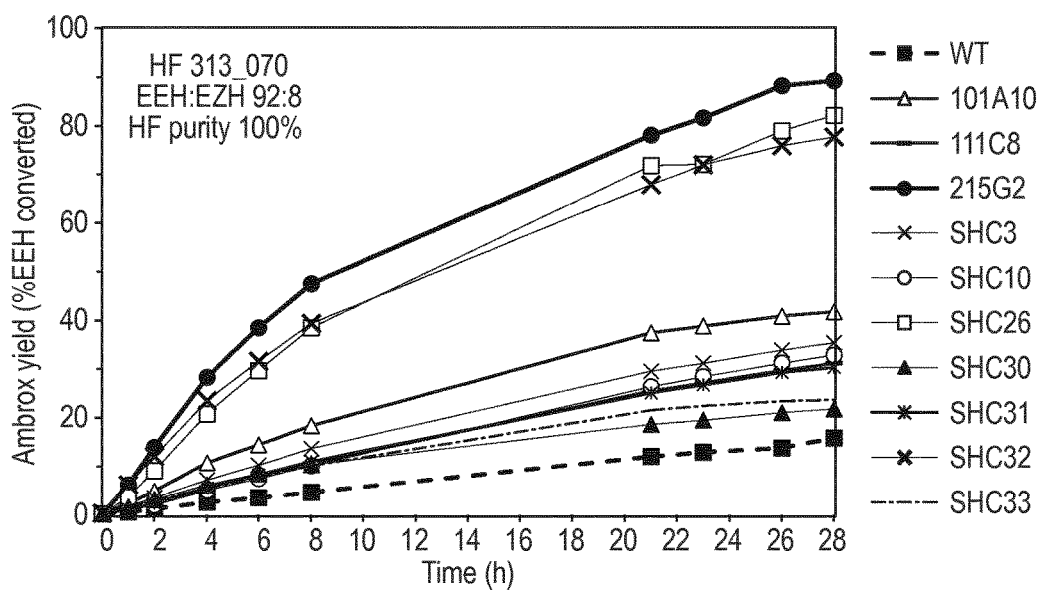
FIG. 8b shows the relative improvement of the AacSHC Derivatives relative to WT SHC (4 h (initial velocity) and yield at 22 h) using Homofarnesol quality EEH:EZH 92:08 and at a 100% purity of Homofarnesol (as determined using NMR)

The result of the standard test run under optimized conditions was are shown in FIG. 8B (activity profiles of the AacSHC derivatives relative to WT AacSHC) and FIG. 8A which shows the relative improvement of the AacSHC Derivatives relative to WT SHC (4 h (initial velocity) and yield at 22 h).

Homofarnesol Used: EEH:EZH 66:33, Purity (NMR): 76%

Figure 9A:
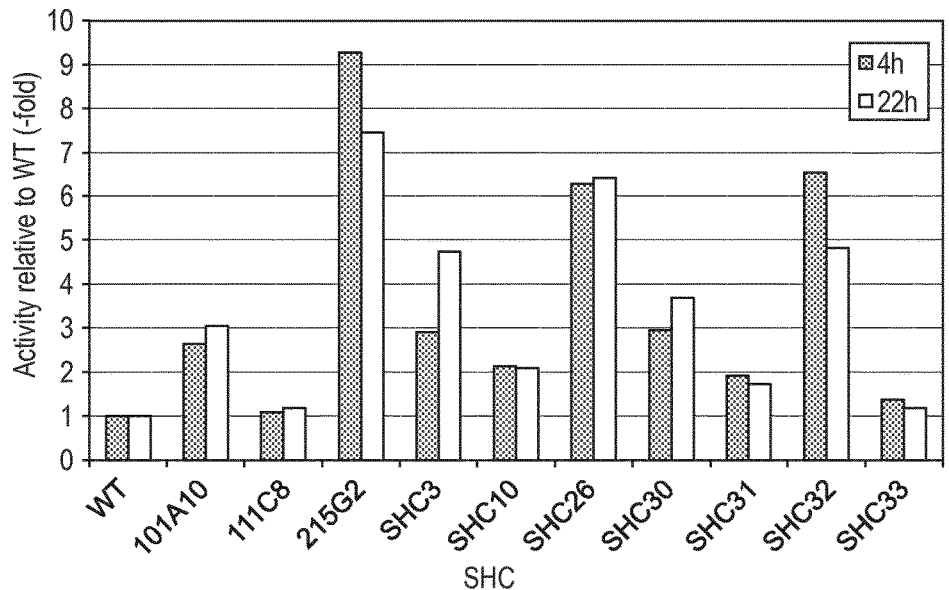
FIG. 9a shows the HAC activity profiles of the AacSHC Derivatives as set out in Table 24 relative to WTAacSHC using Homofarnesol quality EEH:EZH 66:33 and at a 76% purity of Homofarnesol (as determined by NMR)
Figure 9B:
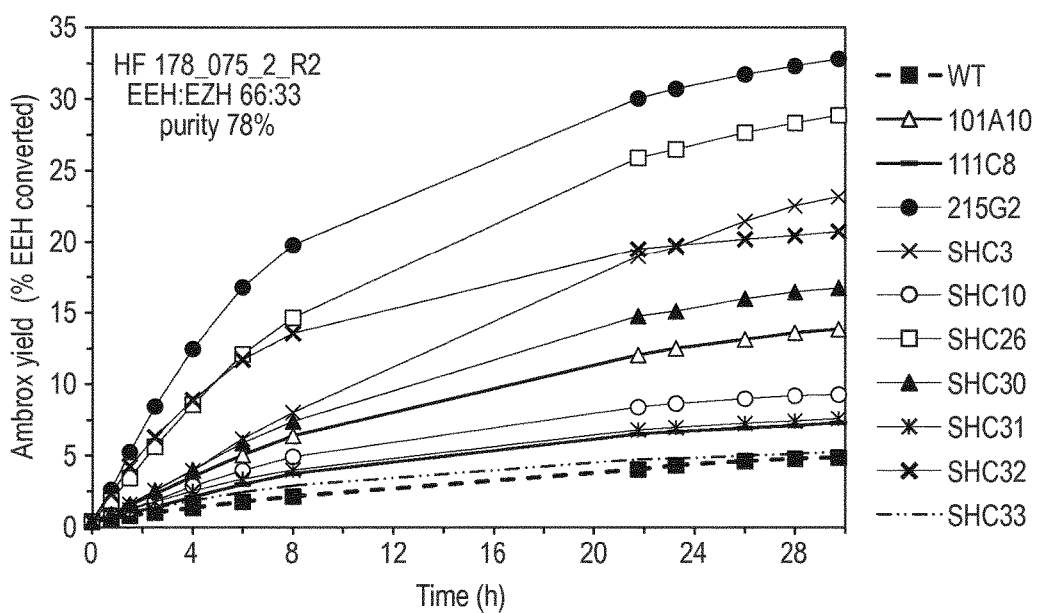
FIG. 9b shows the relative improvement of the AacSHC Derivatives relative to WT SHC (4 h (initial velocity) and yield at 22 h) using Homofarnesol quality EEH:EZH 66:33 and at a 76% purity of Homofarnesol (as determined by NMR)

The result of the standard test run under optimized conditions was are shown in FIG. 9B (activity profiles of the AacSHC derivatives as set out in Table 24 relative to WTAacSHC) and FIG. 9A which shows the relative improvement of the AacSHC Derivatives relative to WT SHC (4 h (initial velocity) and yield at 22 h).

Discussion 5

The main conclusion was that independently of the quality of the Homofarnesol substrate used, the four best SHC derivative enzymes were ranked in the following order: 215GSHC, SHC26, SHC32 and SHC3.

Example 6

Determining the Mass Balance From Reactions Entirely Extracted With Solvent

Method 6

All conditions being unchanged, for each variant 2 reactions were run. Homofarnesol was used as a substrate. After 4 hours and 22 hours of incubation the reaction product and unreacted substrate was extracted totally for each of the variants with a total of 6 washes with an equal volume of tert-Butyl-Methyl Ether (MTBE/tBME). The Homofarnesol and Ambrox content of each of the washes was determined by GC-analysis. The total amount of Ambrox formed and Homofarnesol remaining were calculated from calibration curves that had been prepared using solutions made from authentic Ambrox and Homofarnesol.

Result 6

Figure 10:
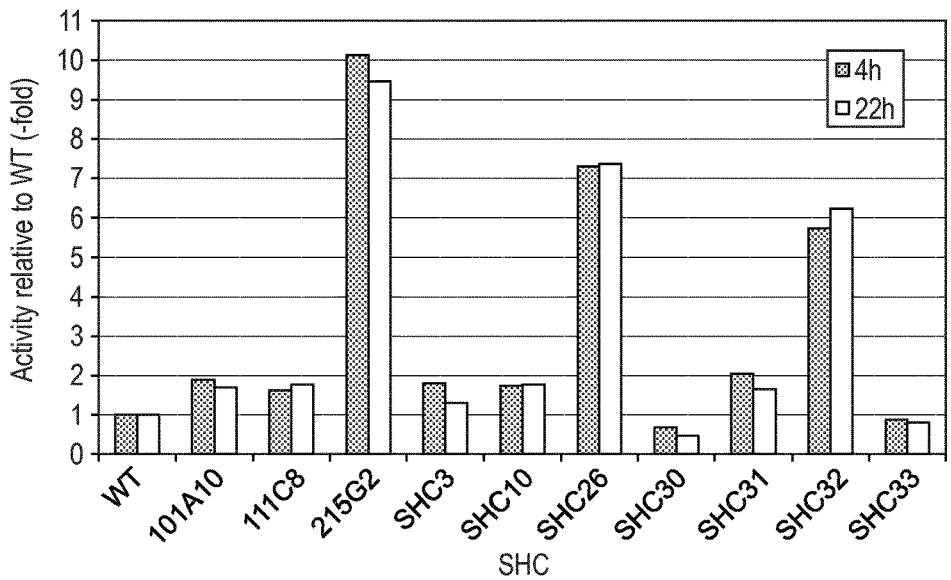
FIG. 10 shows the HAC activity results for three SHC Derivatives showing approx. 10-fold (215G2), 7-fold (SHC26) and 6-fold (SHC32) improvement over the wild-type AacSHC/HAC enzyme.

The results in FIG. 10 showed that with the substrate used, the 3 best variants were confirmed showing approx. 10-fold (215G2), 7-fold (SHC26) and 6-fold (SHC32) improvement over the wild-type SHC enzyme was observed.

Example 7

Performance in biotransformation at 125 g/l E,E-Homofarnesol (EEH)

Method 7

Using 215G2SHC variant, the objective of increasing volumetric productivity was addressed. A design of a series of experimental (DOE) investigations was run to optimize test reaction conditions including parameters pH, cell concentration and SDS concentration. The reaction conditions were: 125 g/l of EEH (from Homofarnesol of EE:EZ 86:14), 250 g/l of cells, 1.55% SDS, the reaction being run at 35° C. in 0.1 M citric acid buffer pH 5.4.

A typical reaction (150 g total volume) is set up as follows: in 0.75 liter Infors fermenters. The reaction vessel is loaded with an appropriate amount of Homofarnesol corresponding to 18.75 g EEH. 2.33 g SDS is added from a 15.5% (w/w) solution prepared in 0.1M citric acid buffer pH 5.4. A cell suspension is prepared from E. coli cells that had produced the 215G2 SHC variant by suspending the cells in 0.1M citric acid buffer pH 5.4. After determination of the cell wet weight of this suspension by centrifugation for 10 min at 10° C. and 17210 g, the appropriate volume of cells is added to the reaction vessel in order to introduce 37.5 g of cells into the reaction. The volume of the reaction is completed to 150 g with the required amount of reaction buffer. The reaction is run at 37° C. under constant stirring at 900 rpm. pH regulation is done using 40% citric acid in water. The reaction is sampled over time (1 ml), extracted with 5 volumes of MTBE/tBME (5 ml). The homofarnesol and Ambrox content of the reaction was determined by GC analysis after clarification of the solvent phase by centrifugation (table top centrifuge, 13000 rpm, 2 min), 10-fold dilution into MTBE/tBME.

The same reaction was carried out with E. coli cells that had produced the wild-type SHC enzyme. In that case was the reaction run at 55° C. in 0.1M citric acid buffer pH 6.0. A summary of the reaction conditions for this Example is provided in row 2 of Table 24a below. The reaction conditions presented in row 1 of Table 24a below are taken from previous Examples (eg Examples 3-5).

TABLE 24a

Row 2 shows the reaction conditions for Example 7

| SHC | Temperature (° C.) | pH | [SDS] (%, w/w) | [EEH] (g/l) | Biocatalyst (g/l) (cell wet weight) |
|---|---|---|---|---|---|
| 215G2 | 35° C. | 5.4 (5.0-6.2) | 0.06 | 4 | 1.45 cells |
| 215G2 | 35° C. | 5.4 (5.0-6.2) | 1.55 | 125 | 250 cells |

Results 7

FIG. 11 shows the observed EEH conversion to Ambrox by the 2 enzymes. At 7 hours of reaction (estimation of initial reaction velocity) conversion with variant 215G2 SHC was 13-fold higher than that achieved with wild-type SHC. At 48 hours of reaction conversion with the variant was about 8-fold that of the wild-type enzyme.

General Comments 7

Cell Concentrations

All concentrations of cells (g/l) in the reactions described this Example are indicated in wet weight of cells. The concentration as cell wet weight (g/l) of a cell suspension is determined after centrifuging a sample of this cell suspension for 10 min at 17210 g and 4° C.

Correlation Between g/l Cells and $OD_{650nm}$

Using 125 g/l EEH bioconversion with the 215G2 SHC or WT SHC the 250 g/l of cells in this reaction correspond to an $OD_{650nm}$ of about 172 in that reaction. Variations in the ratio of $OD_{650nm}$ to biocatalyst amount were observed when different biocatalyst preparations were tested. When the biocatalyst was used in the standard test at 4 g/l EEH but applying the cells to an $OD_{650nm}$ of 10.0 it was estimated that $OD_{650nm}$ of 10.0 is equivalent to 1.45 g/l of cells Discussion 7

The data demonstrates that an optimized and efficient HAC bioconversion process has been developed using relatively high EEH substrate concentrations (125 g/l) compared with the disclosures in the art where only a homofarnesol substrate concentration of from around 0.2 g/l (see JP2009060799) to about 2.36 g/l (10 mM) has been disclosed in the art (see WO2010/139719A2, US2012/0135477A1) and Seitz et al (2012) as cited above).

Example 8

GC Analytics

Methods 8

Samples were extracted with an appropriate volume of tert-butylmethyl ether (MBTE/tBME) for quantification of their content in EEH and Ambrox. The solvent fraction was separated from the water phase by centrifugation prior to analysis with gas chromatography. 1 μl of the solvent phase was injected (split ratio 3) onto a 30 m×0.32 mm×0.25 μm Zebron ZB-5 column. The column was developed at constant flow (4 ml/min $H_2$) with the temperature gradient: 100° C., 15° C./min to 200° C., 120° C./min to 240° C., 4min at 240° C., which resulted in separation of Ambrox, EEH and EZH. Inlet temperature was 200° C., detector temperature: 300° C.

EEH conversion was calculated from the areas of the peaks corresponding to Ambrox and EEH with the following formula:

$$\text{conversion (\%)} = 100 \times (\text{Area}_{Ambrox\_Peak} / (\text{Area}_{Ambrox\_peak} + \text{Area}_{E,E\text{-}Homofarensol\ Peak}))$$

The identity of the reaction product Ambrox was confirmed by GC-MS (recorded values and intensities: m/z 221

(100%), m/z 97 (40%), m/z 137 (3.3%), m/z 43 (2.6%), m/z 41 (2.5%), m/z 55 (2.4%), m/z 95 (1.9%), m/z 67 (1.8%), m/z 81 (138%), m/z 222 (1.7%)).

Discussion 8

Product recovery was carried out by either solvent extraction or steam extraction. Solvents used were eg. MTBE or Hexane:Isopropanol (3:2). The reaction was extracted repeatedly with equal volumes of solvent and the solvent fractions GC-analyzed until no substrate or product was detected anymore. In general 5 to 6 washes were sufficient. Alternatively extraction of reaction products was done by steam extraction.

Example 9

One Pot Reaction

Methods 9

A 200 ml fermentation was run with *E. coli* BL21 (DE3) transformed with the pET28a(+) 215G2 SHC plasmid for the production of 215G2 SHC with N-ter HisTag using the standard growth and induction protocol described above. At the end of the induction phase, the aeration was switched off, the temperature set to 35° C., the pH to 5.5 with citric acid and stirrer speed to 500 rpm. The volume of the culture was estimated from all additions made during culture growth (feed and base consumption). According to this volume and to the OD of the culture, an appropriate amount of SDS was added to the fermenter. EEH was added to 4 g/l. The reaction was sampled over time, the samples (150-300 μl) extracted with 700 μl MTBE for GC analysis. EEH was converted to Ambrox directly in the culture broth. The reaction was run for a total of 22.5 days, during which EEH was added repeatedly.

Results 9

When completion was reached, 10.6 g of EEH had been cyclized to Ambrox. The reaction products (structures provided below) was extracted by steam extraction and was recovered quantitatively from the reaction mixture.

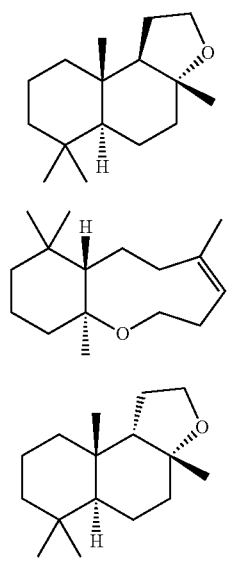

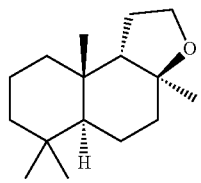

Note on Reaction Products

When Homofarnesol EE:EZ 87:13 is converted by SHC, the reaction products Ambrox, (II), (IV) and (III) as set out in FIG. 12 are produced and reflect the EE:EZ ratio of the starting material.

When EEH is used as a starting material, only (−)-Ambrox (I) and product (IV) are generated.

When EZH (3Z,7E) is used as a starting material, only products (II) and (III) are generated.

However, when a mixture of EEH and EZH are used, Ambrox (I) and products (II), (IV) and (III) are generated.

If a 100% conversion of EE:EZ 66:34 takes place, this will provide 66%:34% ((Ambrox+(IV)):((II)+(III))).

When a steam extraction is carried out, it extracts all 4 products—Ambrox and products (II), (IV) and (III) and a crystallization step generates Ambrox with 99% purity (GC) in at least a 70% yield.

Discussion 9

The data demonstrate that the production of (−)-Ambrox is possible in a bioconversion reaction or a "one pot" reaction system and that a selective enrichment of Ambrox is achieved after steam extraction and crystallization.

If the homofarnesol starting material is a mixture of EE and EZ (eg. 86:14) isomers, then 2 products originate from each of these isomers (4 in total) with (−)-Ambrox being by far the main constituent in the crude product, and the dominant constituent in the crystallized material (purity 99.1%). (+)-Ambrox was not detected.

Example 10

Conversion of EE:EZ Homofarnesol Mixtures

For the avoidance of doubt,

EE corresponds to (3E,7E); EZ mixture corresponds to (3Z,7E); ZE corresponds to (7Z,3E); ZZ corresponds to (7Z,3Z); EEH corresponds to (3E,7E); and EZH corresponds to (3Z,7E).

Methods 10

EE:EZ mixtures were bioconverted under the following reaction conditions: 146 g/l total homofarnesol with 250 g/l cells and 1.55% SDS using the following homofarnesol substrates (EE:EZ homofarnesol mixtures):

EE:EZ 86:14 (highest EEH content for this Example),
EE:EZ 69:31 (lowest EEH content for this Example).
EE:EZ 80:20
EEH:EZH 70:30

Bioconversion of 7E, 3E/7E, 3Z homofarnesol mixture

Bioconversion was undertaken using the following reaction conditions: The reaction (150.1 g total volume) was run in 0.1M citric acid/sodium citrate buffer pH 5.4 in an InforsHT 750 ml fermenter contained 146 g/l total homofarnesol using a homofarnesol substrate, which was a mixture of 7E,3E:7E,3Z of 86:14, 250 g/l cells (produced in accordance with the method of Example 1) and 1.55% SDS. The reaction was run at 35° C. with constant stiffing (800 rpm), pH control was done using 10 to 40% citric acid in water. The reaction mixture was sampled over time, the sample solvent extracted for GC analysis. It was noted that Homofarnesol conversion went equally fast with the 2 qualities of Homofarnesol (EE:EZ 86:14 and EE:EZ 69:31)

Results 10

The conversion of both E,E- and E,Z-Homofarnesol was observed when a bioconversion of 125 g/l E,E-Homofarnesol from the EEH:EZH 86:14 material using the WT SHC and one specific SHC Derivative (215G2 SHC) was carried out. That is, the wild-type SHC enzyme from Alicyclobacillus acidocaldarius produces the same reaction products (i.e. Ambrox, products (II), (IV) and (III)) from EEH:EZH 86:14 material as does an SHC variants from Table 23 from EEH:EZH mixtures. FIGS. 13 and 14 provide a GC-analysis of the reaction products for Ambrox and products (II), (IV) and (III).

Discussion 10

The bioconversion of homofarnesol to Ambrox according to the present disclosure produces (−)-Ambrox as a predominant compound but may also produce compounds other than (−)-Ambrox (eg. compounds (II), (IV) and (III)) as identified above which may or may not impart pleasant olfactive notes to the (−)-Ambrox product. As demonstrated above, under selective crystallization conditions, Ambrox is separable from other by products ((II), (IV) and (III)). Accordingly, if products contribute in a negative matter to the sensory character of the Ambrox end product, the selective separation of products (II), (IV) and (III) from the (−)-Ambrox end product increase its value as a fragrance or flavor or cosmetic or consumer care product. Sensory analysis is carried out using well established sensory tests utilized by trained Perfumers. The purity of the (−)-Ambrox end product may be an indicator of the olfactive quality of the product if the product on its own is mainly responsible for the desired sensory profile

Example 11

EEH conversion from a EE:EZ:ZE:ZZ-Homofarnesol mixture

Methods 11

EE:EZ:ZE:ZZ-Homofarnesol 40:26:20:14 was used as a substrate for EEH conversion with 215G2 SHC. For comparative purposes, other Homofarnesol of EE:EZ 2:1 or 93:07 were also used.

The conversion of the EE:EZ:ZE:ZZ-Homofarnesol mixture was investigated with the 215G2 SHC variant but not under optimized conditions. The reaction conditions were pH 5.8 in 100 mM citrate buffer, 0.10% SDS, 40° C. The following EEH conversions were observed, all reactions being run with constant 2 g/l EEH (accordingly variable total Homofarnesol concentrations)

Results 11

The following homofarnesol isomer mixture conversion rates were observed:

| | |
|---|---|
| EE:EZ 2:1 | 50-55% |
| EE:EZ 93:7 | 78% |
| EE:EZ:ZE:ZZ 40:26:20:14 | 6% |

Discussion 11

Beyond the yields observed, the data demonstrates that the 215G2 SHC variant is capable of converting EEH to Ambrox from a complex EE:EZ:ZE:ZZ Homofarnesol mixture. As expected, a lower conversion rate resulting in a lower Ambrox yield was observed. This result is consistent with the view that homofarnesol isomers other than EEH may compete with EEH for access to the SHC/HAC derivative enzyme and may thus act as competitive inhibitors and/or alternative substrates for the conversion of EEH to (−)-Ambrox.

Example 12

Comparative Data for Whole Cell Bioconversions Using Triton X-100 and SDS

Methods 12

E. coli host cells were grown according to the protocol in Methods 4 of Example 4. The bioconversion reaction using the 215G2SHC variant was carried out according to the standard test in Example 4. The homofarnesol substrate at 4 g/l with cells to $OD_{650nm}$ of 10.0 in citric acid/sodium phosphate buffer 0.1M pH5.4, 35° C. and SDS at 0.07% were chosen as the most suitable reaction conditions for the 215G2 SHC variant.

Results 12

FIG. 15 provides a comparison of the activity of the 215G2SHC variant in the whole cell bioconversion assay when using Triton X-100 at a concentration range of 0.005% to 0.48% and SDS at a concentration of 0.07%.

Discussion 12

The data demonstrates that maximal activity with Triton X-100 was only around 20% of the activity obtained with SDS.

Example 13

SDS/Cells Ratio

Methods 13

The bioconversion reaction was set up according to Methods 4 in Example 4 using EEH substrate at 4 g/l, cells at an $OD_{650nm}$ of 5.0 that had produced the 215G2 SHC derivative enzyme.

Results 13

The results are set out in FIG. 16 which shows the percent converted EEH for different SDS/cells ratios.

FIG. 16 demonstrates that the percent EEH conversion to (−)-Ambrox using different SDS/cells ratio values is dependent on the SDS/cells ratio. This ratio has to be carefully set to achieve maximum conversion.

If, for example, the SDS concentration is too low, a suboptimal homofarnesol conversion may be observed. On the other hand, if, for example, the SDS concentration is too high, then there may be a risk that the biocatalyst is affected through either the disruption of the intact microbial cell and/or a denaturation/inactivation of the SHC/HAC enzyme. When the bioconversion reaction was carried out according to Methods 7 in Example 7 using 125 g/l EEH and 250 g/l biocatalyst, the best bioconversion protocol shows a [SDS]/[cells] ratio of 16:1.

Discussion 13

The results demonstrate that there is a degree of interdependency between the solubilising agent (SDS) concentration, the biomass amount and the substrate (EEH) concentration. By way of example, as the concentration of homofarnesol substrate increases, sufficient amounts of biocatalyst and solubilising agent (SDS) are required for an efficient bioconversion reaction to take place.

Example 14

Testing of Possible Solubilizing Agents for Use in the Bioconversion Reaction

Methods 14

Various solubilizing agents (as outlined in Table 26 below) were tested in 215G2 SHC EEH cyclization reactions using the same conditions as in the standard test (4 g/l EEH, cells to an $OD_{650nm}$ of 10.0) as a possible substitute for SDS. The possibility of enhancing activity (cumulative effect) by combining SDS at its optimal concentration (0.060-0.070%) with other solubilising agents used (at the concentration determined individually as optimal from the screening done with these compounds (see Table 26 below)) was also tested using the standard test. In addition, some "Deep eutectic sol-vents" and ionic liquids, which are known to help in solubilizing water-insoluble compounds were also tested.

Results 14

The following Table 26 summarizes which solubilizing agents (eg.: surfactants, detergents, solubility enhancers and the like) were tested so far in 215G2 SHC EEH cyclization reactions. In no case was an improved activity compared to the control reaction carried out using SDS at a concentration in the range of 0.060-0.070%. Activities observed with these compounds used alone at the concentration defined as optimal were only about 20% of what was obtained in control reactions with SDS. It was noted that when no solubilizing agent at all was added 20% EEH conversion was achieved. When SDS was used and an additional solubilizing agent was added (at a concentration defined as optimal in the test), no synergistic effect was observed. Rather, a decrease in percent EEH conversion was observed. It can be concluded from the study that under tested conditions the compounds do not improve EEH conversion at all; rather adverse effects on cyclization are obtained, and that SDS is the most useful of the solubilizing agents studied. In addition, no positive results were obtained from the tests using "deep eutectic solvents" and ionic liquids, which are known to help in solubilizing water-insoluble compounds.

TABLE 26 provides a list of solubilizing agents which were tested in the bioconversion reaction

| Solubilizing agent | Concentration range tested |
|---|---|
| Caprylyl sulfobetaine | 0.19-3.0% |
| CHAPS | 0.020-0.18% |
| Cremophor EL | 0.0063-0.5% |
| Dimethyl sulfoxide | 0.00032-0.2% |
| Hexadecylpyridinium chloride monohydrate | 0.013-0.5% |
| Myristyl sulfobetaine | 0.0009-0.03% |
| Nonidet P40 | 0.005-0.16% |
| Octyl-β-D-glucopyranoside | 0.0008-0.6% |
| Palmitylsulfobetaine | 0.00000003-0.03% |
| Pluronic P-105 | 0.000074-0.018% |
| Quaternary ammonium salts (eg. tetramethyl ammonium bromide) | 20-160 mM |
| Sodium taurodeoxycholate hydrate | 0.05-0.4% |
| Stepan ® | 0.01-0.6% |
| Thesit ® | 0.05-0.8% |
| Triton X-100 | 0.005-0.32% |
| Tween 20 | 0.05-0.8% |
| Tween 80 | 0.01-0.4% |

Discussion14

The Applicant selected and identified SDS as a useful solubilising agent from a long list of other solubilizing agents which were shown not to be useful in the homofarnesol to (−)-Ambrox bioconversion reaction of the present disclosure.

Example 15

Sensitivity to SDS Concentration in the Bioconversion Reaction

Methods 15

The conditions applied are the conditions of the standard bioconversion (as described in Example 7) at 125 g/l with 250 g/l biocatalyst and 1.55% SDS. Two other SDS concentrations (1.40% and 1.70% SDS were also tested). All SDS concentrations are in weight/weight %.

The standard bioconversion reaction conditions (as described in Example 7) at 125 g/l with 250 g/l biocatalyst and 1.55% SDS were also used to test different pH values. The control was run in pH 5.4 in 0.1 M citric acid buffer. The reactions run at lower pH were run with 0.1M acetic acid buffer.

Results 15

The data in FIG. 17 demonstrate that the bioconversion reaction appears to be less sensitive to changes in SDS concentrations than when the HAC activity was tested in the standard test at 4 g/l EEH and cells applied to an $OD_{650nm}$ of 10.0.

The data in FIG. 18 demonstrate that when the bioconversion reactions are applied, the system appears to be less sensitive to pH variations than when the HAC activity is tested in the standard test at 4 g/l EEH and cells applied to an $OD_{650nm}$ of 10.0.

Discussion 15

The data demonstrates the robustness of the bioconversion reaction at 125 g/l EEH and 250 g/l of cells with regard to the SDS concentration range and the pH range tested.

Example 16

Location of the Identified SHC/HAC Mutations on the Crystal Structure

The positions of the mutations identified in the AacSHC/HAC variants are marked in FIG. 19 as follows: red for variant 215G2; purple (wine red) for variant 101A10 and green for variant 111C8. For the amino acids identified at as being responsible for the increased activity, the side-chains are highlighted in yellow in the co-crystallized substrate analog. Other mutations for identified variants with no improved activity are marked in blue. It is noted that blue mutations are spread about half-half (i.e. 50:50) over the 2 domains of the enzyme, whereas the beneficial AacSHC mutations which were identified are located mostly (apart from one) in domain 2. The only exception is the mutation F601Y which is in the vicinity of the active site. If only both of the SHC/HAC derivative enzymes 215G2 and 111C8 are considered, then all of the mutants are located in domain 2. FIG. 20 provides the same information in black and white.

Results 16

All of the beneficial mutants (red/green/purple) corresponding to 215G2, 111C8, and 101A10 are located mostly (apart from one mutant F601Y) in domain 2 (Wendt et al (1997) Science 277: 1811) of the SHC crystal structure (as provided in FIG. 19). The SHC beneficial mutations combinations are numbered according to wild-type AacSHC (SEQ ID No. 1).

Discussion 16

The crystal structure is useful for identifying SHC/HAC derivatives with desirable structure/activity relationships especially in relation to the conversion of homofarnesol to (−)-Ambrox. A useful pre-selection step might be to restrict the selection to amino acid residues located in domain 2 of the SHC/HAC crystal structure (see FIGS. 19 and 20).

Example 17

Preparation of Homofarnesol
Methods 17
General Analytical Conditions

Non-polar GC/MS: 50° C./2 min, 20° C./min 200° C., 35° C./min 270° C. GC/MS Agilent 5975C MSD with HP 7890A Series GC system. Non-polar column: BPXS from SGE, 5% phenyl 95% dimethylpolysiloxane 0.22 mm×0.25 mm×12 m. Carrier Gas: Helium. Injector temperature: 230° C. Split 1:50. Flow: 1.0 ml/min. Transfer line: 250° C. MS-quadrupol: 106° C. MS-source: 230° C.

A) Preparation of MNU in THF

A solution of urea (175 g, 2.9 mol) and methylamine hydrochloride (198 g, 2.9 mol) in water (400 ml) is heated at reflux (105° C.) for 3.5 h under stirring. At 40° C. NaNO$_2$ (101 g, 1.45 mol) dissolved in water (200 ml) is added. After 15 min THF (1000 ml) is added which results in a transparent 2-phase mixture. Conc. H2SO4 (110 g, 1.1 mol) is added at 0-5° C. and stirring within 1.5 h. After another 0.5 h at 0-5° C. the two transparent phases are separated at 25° C. The organic phase (A) (1065 ml, theoretically 1.35M) is stored for a few days at 0-5° C. or forwarded immediately to the cyclopropanation reactor.

After phase separation the water phase is extracted twice with THF (2× 1:1). This gives 1100 ml of phase B and 1075 of phase C. Whereas phase A gives a 51% conversion of a terminal alkene to a cyclopropane in a subsequent cyclopropanation reaction, phase B gives <0.5% cyclopropane and phase C gives no detectable conversion. We conclude that >99% MNU is extracted after the first phase separation. Usually the water phase is therefore discarded after the first phase separation (from organic phase A) after treatment with conc. aqueous KOH and acetic acid.

B) Preparation of E-Δ-Farnesene Using MNU in THF

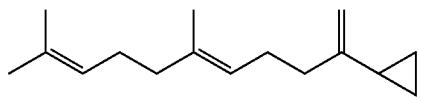 [SMILES: C=C(CC/C=C(\C)CCC=C(C)C)C1CC1]

N-Methyl-N-nitroso urea 1.35M in THF (136 ml, 184 mmol) is added dropwise at 0° C. to a rapidly stirred mixture of E-beta-Farnesene (CAS 18794-84-8) (25 g, 122 mmol) and aqueous KOH (50 ml, 40%) at 0-5° C. After the addition of 4 ml of the MNU solution, Pd(acac)2 (7.4 mg, 0.024 mmol, 0.02%) pre-dissolved in 0.5 ml dichloromethane is added.

The remaining MNU solution is added over 4 h at 0-5° C. A GC at this stage showed 28% unconverted E-β-Farnesene, 65% of the desired monocyclopropane (shown above) and 3% of a biscyclopropanated compound 5. After 16 h at 25° C. acetic acid (100 ml) is added at 0-5° C., then tert-butyl methyl ether (250 ml). After phase separation the organic phase is washed with 2M HCl (250 ml) and the aqueous phase extracted with tert-butyl methyl ether (250 ml). The combined organic layers are washed with water (2×100 ml), aqueous 10% NaOH (2×100 ml) and water (2×100 ml), dried over MgSO4, filtered and concentrated to give 26.9 g of a slightly yellow liquid which contains 9% E-β-Farnesene, 82% of the desired monocyclopropane compound and 6% of a biscyclopropanated side product.

The desired compound could be further isolated by distillative purification. Addition of 1 g K$_2$CO$_3$ (1 g) and distillation over a 30cm steel coil column at 40-60 mbar gives 147 g monocyclopropane compound (68% corr) at 135-145° C. The fractions are pooled to give 92 g monocyclopropane compound of 100% purity.

Analytical Data of E-Δ Farnesene:

1H-NMR (CDCl3, 400 MHz): 5.1 (2 m, 2 H), 4.6 (2 H), 2.2 (2 H), 2.1 (4 H), 2.0 (2 H), 1.7 (s, 3 H), 1.6 (2 s, 6 H), 1.3 (1 H), 0.6 (2 H), 0.45 (2 H) ppm. 13C-NMR (CDCl3, 400 MHz): 150.9 (s), 135.1 (s), 131.2 (s), 124.4 (d), 124.1 (d), 106.0 (t), 39.7 (t), 35.9 (t), 26.7 (t), 25.7 (q), 17.7 (q), 16.0 (d), 6.0 (t) ppm. GC/MS: 218 (2%, M+), 203 (5%, [M−15]+), 175 (11%), 147 (31%), 134 (15%), 133 (20%), 121 (12%), 107 (55%), 95 (16%), 93 (30%), 91 (20%), 82 (11%), 81 (33%), 79 (42%), 69 (100%), 67 (22%), 55 (20%), 53 (21%), 41 (75%). IR (film): 3081 (w), 2967 (m), 2915 (m), 2854 (m), 1642 (m), 1439 (m), 1377 (m), 1107 (w), 1047 (w), 1018 (m), 875 (s), 819 (m), 629 (w). Anal. calcd. for C16H26: C, 88.00; H, 12.00. Found: C, 87.80; H, 12.01.

C) Preparation of (7E)-4,8,12-trimethyltrideca-3,7,11-trien-1-ol ((7E)-homo-farnesol)

A mixture of (E)-(6,10-dimethylundeca-1,5,9-trien-2-yl) cyclopropane (E-Δ Farnesene) (1 g, 4.6 mmol), dodecane (0.2 g, 1.15 mmol, internal standard) and L-(+)-tartaric acid (1 g, 6.9 mmol) in a pressure tube is heated under stiffing at 150° C. After 18 h and complete conversion (according to GC) the mixture is poured on water (50 ml) and toluene (50 ml).

The phases are separated and the aqueous phase extracted with toluene (50 ml). The combined organic layers are washed with conc. aqueous Na2CO3 (50 ml) and conc. NaCl (2×50 ml), dried over MgSO4, filtered and evaporated under reduced pressure to give a brownish resin (1.35 g) which is mixed with 30% aqueous KOH (4.3 ml) and stirred at 25° C. for 2 h. GC analysis reveals formation of 96% (7E)-4,8,12-trimethyltrideca-3,7,11-trien-l-ol according to the internal standard. E/Z ratio 68:22. The analytical data of the E-isomer are consistent with the ones from the literature, see for example P. Kocienski, S. Wadman J. Org. Chem. 54, 1215 (1989).

Results 17

The data demonstrates the preparation of homofarnesol which is suitable for bioconversion to (−)-Ambrox.

Discussion 17

This process for the preparation of homofarnesol is also described in detail in two co-pending patent applications—PCT/EP2014/072882 (WO2015/059290) and PCT/EP2014/072891 (WO2015/059293)—the entire contents of which are incorporated herein by reference.

Example 18

One Pot Reaction

In this experiment: (i) a fermentation with an *E. coli* strain producing the 215G2 SHC variant (eg. as described in Example 1) followed by (ii) EEH conversion directly in the fermentation broth was carried out. Because the 3 parameters [cells], [EEH] and [SDS] (g/l) are linked, it was required to adjust the parameters [EEH] and [SDS] in the available volume of fermentation broth depending on the concentration of the cells (g/l) obtained at the end of the fermentation. The target was to convert 125 g/l EEH with 250 g/l cells at an SDS concentration of 1.55%. To allow for a proper bioconversion, the cells must be in a resting state, in a status of glucose depletion. Aeration was switched off.
Method 18
Fermentation:

In order to allow for a quite accurate determination of the volume of the fermentation broth in the reactor at the end of the fermentation, the volumes of withdrawn samples as well as the volumes of all additions made to the fermenter (feed, base, acid, . . . ) were recorded.

Determination of Cell Concentration in the Fermentation Broth:

A sample of fermentation broth (5-10 ml) was drawn under constant agitation for cell wet weight (g/l) determination and placed into a centrifuge tube. Sample mass was recorded. The sample is centrifuged for 10 min at 17210 g and 4° C. (eg. 12000rpm, SS-34 rotor, Sorvall RC3B centrifuge). The supernant was withdrawn with careful pipetting and the mass of the pellet was recorded. The cell wet weight concentration is determined was $g_{cells}/l_{broth}$ or $g_{cells}/g_{broth}$.

The volume of the fermentation broth in the fermenter was determined according to all additions and withdrawals. In case the fermenter was on a scale, the mass of the fermentation broth was determined by weighing, if not it was assumed that 1 ml=1 g.

Determination of Required Homofarnesol and SDS Quantities:

According to the determined cell concentration and volume of the fermentation broth the amount of E,E-Homofarnesol and SDS to add to the reactor was determined in order to keep the same ratio between the 3 as set out in the bioconversion described in Example 9: 125 g/l EEH, 250 g/l cells, 1.55% SDS.

Setting Up the Bioconversion:
1. Temperature was set to 35° C. Aeration is switched off.
2. To the fermentation broth was added the calculated amount of Homofarnesol.
3. The required amount of SDS was carefully added from an aqueous 15.5% SDS stock solution.
4. The reaction was mixed well for approx. 15 min at 800 rpm.
5. The pH of the reaction was recorded (internal pH electrode).
6. A sample (approx. 1 ml) was drawn to a 15 ml Falcon tube. Approx. 5 ml deionized water was added and the pH was recorded at an externally calibrated electrode after thorough mixing.
7. The pH in the reactor was set stepwise to 5.4 (value measured at the externally calibrated electrode) using 85% $H_3PO_4$ while regularly controlling pH at the external electrode was described above (6.).
8. pH was regulated during bioconversion using eg. 10-25% $H_3PO_4$ and 32% NaOH.
9. Reaction sampling: approx. 1 ml reaction mixture was placed in a 15 ml falcon tube. Approx. 5 ml MTBE is added. The sample was extracted with vigourous
10. shaking. An aliquot was centrifuged in a tabletop centrifuge for 1 min at maximum speed (Eppendorf tube). 100 μl of the solvent phase was added to a GC vial containing 900 μl MTBE. Samples were taken every 1-1.5 hours during the first day of bioconversion. The following days only 3 samples a day were taken.
11. 1 μl of the solvent phase was analyzed for its Ambrox and EEH content as described in Example 8.
12. EEH conversion (%) is calculated as 100×($Ambrox_{area}$/($Ambrox_{area}$+$EEH_{area}$)).

Result 18

The results demonstrate that a one-pot fermentation+EEH conversion was carried out in a KLF2000 reactor (Bioengineering) at a scale of 1.9 litres. 251 g/l cells allowed conversion of 238 g EEH (251 g/l cells) to ≥93% in 47 hours. When measured 93 h after start, conversion was 99%.

A similar one-pot experiment was run in an Infors HT 0.75 l reactor. After a fermentation that followed a standard protocol (Example 1) the reactor cells that had been collected from other fermentations run in parallel with the same protocol were added. The resulting broth volume was 479 g. The cell concentration was determined as 313.7 g/l, which was 1.25× the concentration of cells in a regular bioconversion (250 g/l cells). EEH and SDS were added accordingly to the reactor. 75.1 g EEH (equivalent to 157 g/l EEH in this Example) were converted to 98% in less than 90 h. This result demonstrates that it is possible to run a one-pot fermentation+EEH conversion at ≥125 g/l EEH as long as the fermentation run provides cells that have produced the 215G2 SHC variant at a high enough cell density.

Discussion 18

Advantageously, 99% conversion of the substrate was obtained which is very commercially useful when expensive starting material (eg. EEH) are used.

Example 19

Increasing Volumetric Productivity.
Method 19

In order to increase further the volumetric productivity a 1.5× concentrated bioconversion containing 375 g/l of cells, 188 g/l EEH, 2.33% SDS was run. A regular bioconversion was run in parallel at 125 g/l EEH, 250 g/l cells, 1.55% SDS (Example 7).

The 2 reactions were run in Infors HT 0.750l reactors, all other parameters being unchanged.
Result 19

The results in FIG. 22 demonstrate that the percent conversion 75 h after start was 88% in the 1.5× bioconversion vs. 95% in the regular bioconversion. The percent conversion 96 h after start was 93% EEH convert in the 1.5× bioconversion vs. 97% in the regular bioconversion. The percent conversion in the 1.5× bioconversion was 96% of that obtained in the regular bioconversion. It was noted that stirring in the 1.5× bioconversion became more difficult over time as the oily Homofarnesol disappeared, being replaced by solid reaction products. This may explain the slightly lower conversion level in the 1.5× bioconversion. Using a reactor equipped with a better mixing device might improve the EEH conversion in a 1.5× bioconversion. The result indicate that it is possible to run bioconversions at 188 g/l EEH or higher provided efficient mixing is achieved; stiffing efficiency appears to be the only limitation of the system.
(−)-Ambrox Productivity The "(−)-Ambrox productivity" refers to the amount of recoverable (−)-Ambrox in grams per liter of biotransformation and per hour of bioconversion time (i.e. time after the substrate was added). In this regard and with reference to FIG. 22, the (−)-Ambrox productivity is calculated as follows:

125 g/l EEH Bioconversion (250 g/l cells)
productivity at 1.25 h: 10.3 gram per liter per hour
roductivity at 8.25 h: 6.3 gram per liter per hour
productivity at 21.25 h: 4.1 gram per liter per hour
187.5 g/l EEH Bioconversion (375 g/l cells)
productivity at 1.25 h: 12.2 gram per liter per hour
productivity at 8.25 h: 8.2 gram per liter per hour
productivity at 21.25 h: 5.5 gram per liter per hour It can be considered that the productivity calculated at around 6-8 hours after start is representative of the initial velocity of the reaction, which describes best the maximal conversion rate of the system.

Typical bioconversions using 125 g/l EEH with 250 g/l cells show an Ambrox productivity of between 6.3 and 8.5 gram per litre per hour after around 6-8 hours (representative of the initial velocity of the reaction).

Example 20

Replacing Reaction Buffer With NaCl Solution
Method 20

A regular bioconversion (125 g/l EEH, 250 g/l cells, 1.55% SDS) was run as described in Example 7 but replacing the citric acid buffer pH 5.4 by either 0.5% or 0.9% NaCl, all other reaction parameters being unchanged. A bioconversion in citric acid buffer was run in parallel as a control.
Result 20

The results in FIG. 23 demonstrate that the EEH conversion rate was the same as in the reactions run in buffer and 0.9% NaCl. The conversion rate was lower when in the reaction run in only 0.5% NaCl. The result demonstrates the possibility of running bioconversion in the absence of buffer provided accurate pH regulation and a sufficient ionic strength are guaranteed.

Example 21

Extraction of the Solid Phase of the Reaction Broth

Given that (−)-Ambrox is not being soluble in water and is not liquid at temperatures below approx. 75° C., these properties were taken as possible advantages to extract the product from the solid phase of the biotransformation using either water miscible (eg. ethanol) and water unmiscible (eg. toluene) solvents.
Method 21

200 ml reaction broth was centrifuged to separate the solid from the liquid (aqueous) phase (Sorvall GS3, 5000 rpm, 10 min, 10° C.). This separated approx. 80 ml solid pellet from approx. an 120 ml liquid phase. Analysis (Gas chromatography, Example 8) of the aqueous phase after MTBE extraction showed that it contained not more than approx. 0.3% of the (−)-Ambrox initially present in the 200 ml reaction broth. Toluene and ethanol 99% were used for extracting Ambrofix from the solid phase.
Result 21
Toluene Extraction:

80 ml solid phase was extracted 6× with 45 ml toluene (approx. ½ solid phase volume, vigorous shaking for 30 s, centrifugation (Sorvall GS3, 5000 rpm, 10 min, 10° C.). The solvent phase was analyzed with GC for its (−)-Ambrox content. Over 99.5% of (−)-Ambrox initially present in the reaction broth were extracted with 6 extractions representing a total toluene vol. of 1.35× the initial whole reaction broth volume (200 ml) or 3.4× the vol. of the solid phase. The graph in FIG. 24 shows the evolution of the extraction over the toluene washes as % of the (−)-Ambrox quantity initially present in 200 ml whole reaction broth (due to the volume ratio broth/toluene, % in the first extract goes over 100%).
Ethanol Extraction: 80 ml solid phase was extracted (Infors Multifors HT, 35° C., 1000 rpm, 30 min) with approx. 160 ml (2 vol.) ethanol 99%, followed by centrifugation. Ambrox did not crystallize during the extraction procedure. The graph in FIG. 25 shows that after 4 washes (total 640 ml EtOH, i.e. 3.2×0 the initial whole reaction broth volume or 8× the volume of the solid phase), about 99% of Ambrox initially present in the reaction broth was recovered. Sufficient ethanol is required in the first extraction step to prevent Ambrox crystallization (solubility in ethanol). When only 1 or ½ vol of the solid phase was used in the first extraction step, a sticky paste was obtained, which was difficult to handle and (−)-Ambrox crystallized as needles on the pellet during centrifugation. Temperature appeared as not being the factor responsible for this crystallization (extraction and centrifugation tested at room temperature and approx. 35° C.-40° C.).

The (−)-Ambrox concentration in the EtOH phase as well as the EtOH/water ratio of the liquid phase (residual moisture of the solid phase) appeared to be responsible for crystal formation. It was however noted that it was possible to reduce the volume of ethanol to 1 vol of the solid phase.
Comment 21

As (−)-Ambrox is not in the liquid phase at room temperature, it separates with the biomass and can be extracted with an organic solvent (eg. a water miscible solvent (eg. ethanol) or a non-water miscible solvent (eg. toluene). The centrifugation step that separates the (−)-Ambrox into the solid phase of the reaction mixture is advantageous because it reduces the amount of solvent required to extract (−)-Ambrox.

Example 22

Sensory Analysis

Purpose: to carry out a sensory analysis of (−)-Ambrox and the by-products (compounds II, III and IV) formed in the "crude" extract and in the "crystallised" extract.
Result 22(a)

EEH transformation results in (−)-Ambrox (compound I) and (−)-Ambrox isomer (Compound IV).
Result 22(b)

EZH biotransformation results in a macrocyclic ether (compound II) and 9b-epi-Ambrox (compound III).
Result 22(c)

A crude composition of (−)-Ambrox comprises compounds I, II, III and IV with each % compound present in an amount of 87.1, 2.8, 2.5 and 7.6% respectively.
Result 22(d)

A composition of the selectively crystallised material (lab scale) has the same components present in an amount of 99.1, 0.1, 0.1 and 0.7% respectively.
The Sensory Analytical Results Were as follows:
(−)-Ambrox: OTH 0.2 ng/l (OTH is odor threshold).
Compound IV from EEH: weak, IsoE, woody, GC-TH 5-10 ng.
Compound II from EZH: "odorless" (GC-TH>500 ng) (GC-TH is the detection threshold).

Compound III from EZH: GC-TH about 10× higher than Ambrox (circa 2 ng).

Conclusion

The total percent of each of the 3 by-products (compounds II, III and IV) in the "crude" extract is about 3%.

The total percent of each of the 3 by-products (compounds II, III and IV) in the "crystallised" extract is about 1% (lab scale).

The sensory analysis of the 3 by-products (compounds II, III and IV) indicates a weaker odor than that from (−)-Ambrox.

In fact, the 9b-epi-ambrox (compound III) odor is about 10 fold weaker than (−)-Ambrox suggesting that it is essentially odorless.

The sensory analysis demonstrated that the removal of one of more by-product compounds from (−)-Ambrox can improve the odor of the remaining compound (i.e. (−)-Ambrox) even if the removed compounds are actually odorless compounds per se. That is, an Ambrox odor enhancement was observed in the absence of compounds II, III and IV.

Example 23

Ambrox Recovery by Steam Extraction

Methods 23

Resulting Purity of the Crude (Steam Extracted) and Crystallized (−)-Ambrox

The EE:EZ 86:14 biotransformation reaction mixture was steam extracted and the reaction product crystallized as follows: The steam distillate was collected as a biphasic mixture. The organic phase was retained and the aqueous phase discarded. The composition of the organic phase was analysed by GC and the results shown in the Table 25 below (see "crude"). The organic phase was then concentrated to dryness.

Ethanol was then added to the crude, dried product and the mixture warmed until the product was dissolved. At room temperature water is slowly added and (−)-Ambrox crystallizes under occasional stirring and cooling in an ice bath.

Results 23

Table 25 below also shows the GC analytics results for products obtained after the steam extraction/distillation step ("crude") and the crystallized product ((−)-Ambrox). The references in Table 25 to "EZH" and "EEH" refer to (3Z,7E) homofarnesol and 7E,3E homofarnesol respectively.

Table 25 indicates that the particular starting material (EEH:EZH 86:14) produces the desired end product (−)-Ambrox and a very specific mixture of by-products (II, IV and III) using the WT SHC or a SHC derivative. The data for the selective crystallization show a strong enrichment of (−) Ambrox (I), with practically no by-products (II), (IV) or (III) being found in the crystallized sample. Accordingly, this EE:EZ mixture provides an olfactively pure (−)-Ambrox product which is selectively crystallised in a relatively straightforward and cost-effective matter.

TABLE 25 shows the GC analytics results for the crystallized product.

| | Peak area (GC) | | | | | | Ambrox |
|---|---|---|---|---|---|---|---|
| | (II) | (IV) | (III) | Ambrox | EZH | EEH | (%) |
| Crude | 215073 | 190376 | 588769 | 6751605 | 13429 | 14184 | 86.9 |
| Crystallized | 10088 | 8951 | 64625 | 9032941 | 0 | 0 | 99.1 |

Discussion 23

Steam extraction/filtration are environmentally friendly methods for isolating Ambrox because it offers a convenient solvent-free isolation of Ambrox with an associated inactivation of the biocatalyst.

Summary 23

The (−)-Ambrox produced using the bioconversion reaction may be extracted using solvent from the whole reaction mixture (eg. using a non-water miscible solvent or by steam extraction/distillation or by filtration) or from the solid phase (eg. using a water miscible solvent) using methods which are known to those skilled in the art.

SEQUENCE LISTING (188 sequences)

SEQ ID NO: 1 - protein, 631 aa, Alicyclobacillus acidocaldarius [sequence omitted]

SEQ ID NO: 2 - protein, 725 aa, Zymomonas mobilis
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVFTRYWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKIPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGFPGYGVGQTIKLDDPALSKRLLQGAELSRAFMLRYDFYRQFFPIMALSRAERLIDLNN

SEQ ID NO: 3 - protein, 658 aa, Zymomonas mobilis
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVFTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGFPRVFYLRYHGYSKYFPLWALARYRNLKKANQPIVHYGM

SEQ ID NO: 4 - protein, 684 aa, Bradyrhizobium japonicum
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVFTRYWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKIPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCMWLVERQSAGTWDEPEFTGTGFPGYGVGQTIKLNDPALSQRLMQGPELSRAFMLRYGMYRHYFPLMALGRALRPQSHS

SEQ ID NO: 5 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGAWALYPGGPPDLDTTIEAYVALKYIGMSRDEEPMQKALRFIQSQGGIESSRVFTRMWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHIPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGFPGDFYLGYTMYRHVFPTLALGRYKQAIERR

SEQ ID NO: 6 - DNA, 1896 bp, Artificial sequence
  Synthetic AacSHC Derivative
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcgcgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgttcacgcggatgtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacatcccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggcttcccaggggatttctacctcggctacaccatgtaccgccacgtgtttccgacgctcgcgctcggccgctacaagcaagccatcgagcgcaggtga

SEQ ID NO: 7 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTVEAYVALKYIGMSRDEEPMQKALRFIQSQGGIESSRVFTRMWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHIPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGFPGDFYLGYTMYRHVFPTLALGRYKQAIERR

SEQ ID NO: 8 - DNA, 1896 bp, Artificial sequence
  Synthetic AacSHC Derivative
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccgtcgaggcgtacgtcgcgctcaagtatatcggcatgtcgcgcgacgaggagccgatgcagaaggcgctccggttcattcagagccagggcgggatcgagtcgtcgcgcgtgttcacgcggatgtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacatcccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggcttcccaggggatttctacctcggctacaccatgtaccgccacgtgtttccgacgctcgcgctcggccgctacaagcaagccatcgagcgcaggtga

SEQ ID NO: 9 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVLTRMWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHIPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGFPGDFYLGYTMYRHVFPTLALGRYKQAIERR

SEQ ID NO: 10 - DNA, 1896 bp, Artificial sequence
  Synthetic AacSHC Derivative
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgctcacgcggatgtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacatcccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggcttcccaggggatttctacctcggctacaccatgtaccgccacgtgtttccgacgctcgcgctcggccgctacaagcaagccatcgagcgcaggtga

SEQ ID NO: 11 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRRWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHIPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGFPGDFYLGYTMYRHVFPTLALGRYKQAIERR

SEQ ID NO: 12 - DNA, 1896 bp, Artificial sequence
  Synthetic AacSHC Derivative
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgttcacgcggaggtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacatcccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggcttcccaggggatttctacctcggctacaccatgtaccgccacgtgtttccgacgctcgcgctcggccgctacaagcaagccatcgagcgcaggtga

SEQ ID NO: 13 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRMWLALVGEYPWEKVPMVPPEIMFLGKRMPLNIYEFGSWARATVVALSIVMSRQPVFPLPERARVPELYETDVPPRRRGAKGGGGWIFDALDRVLHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHIPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGFPGDFYLGYTMYRHVFPTLALGRYKQAIERR

SEQ ID NO: 14 - DNA, 1896 bp, Artificial sequence
  Synthetic AacSHC Derivative
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgttcacgcggatgtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggtgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacatcccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggcttcccaggggatttctacctcggctacaccatgtaccgccacgtgtttccgacgctcgcgctcggccgctacaagcaagccatcgagcgcaggtga

SEQ ID NO: 15 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRMWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHTPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGFPGDFYLGYTMYRHVFPTLALGRYKQAIERR

SEQ ID NO: 16 - DNA, 1896 bp, Artificial sequence
  Synthetic AacSHC Derivative
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgttcacgcggatgtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacaccccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggcttcccaggggatttctacctcggctacaccatgtaccgccacgtgtttccgacgctcgcgctcggccgctacaagcaagccatcgagcgcaggtga

SEQ ID NO: 17 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRMWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHIPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVHYLVETQRPDGGWDEPYYTGTGFPGDFYLGYTMYRHVFPTLALGRYKQAIERR

SEQ ID NO: 18 - DNA, 1896 bp, Artificial sequence
  Synthetic AacSHC Derivative
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgttcacgcggatgtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacatcccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcattacctcgtggagacgcagcgcccggacggcggctgggatgagccgtactacaccggcacgggcttcccaggggatttctacctcggctacaccatgtaccgccacgtgtttccgacgctcgcgctcggccgctacaagcaagccatcgagcgcaggtga

SEQ ID NO: 19 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRMWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHIPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGYPGDFYLGYTMYRHVFPTLALGRYKQAIERR

SEQ ID NO: 20 - DNA, 1896 bp, Artificial sequence
  Synthetic AacSHC Derivative
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgttcacgcggatgtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacatcccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggctacccaggggatttctacctcggctacaccatgtaccgccacgtgtttccgacgctcgcgctcggccgctacaagcaagccatcgagcgcaggtga

SEQ ID NO: 21 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRRWLALVGEYPWEKVPMVPPEIMFLGKRMPLNIYEFGSWARATVVALSIVMSRQPVFPLPERARVPELYETDVPPRRRGAKGGGGWIFDALDRVLHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHTPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGFPGDFYLGYTMYRHVFPTLALGRYKQAIERR

SEQ ID NO: 22 - DNA, 1896 bp, Artificial sequence
  Synthetic AacSHC Derivative
atggctgagcagttggtggaagctccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgttcacgcggaggtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggtgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacaccccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggcttcccaggggatttctacctcggctacaccatgtaccgccacgtgtttccgacgctcgcgctcggccgctacaagcaagccatcgagcgcaggtga

SEQ ID NO: 23 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRRWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHTPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGFPGDFYLGYTMYRHVFPTLALGRYKQAIERR

SEQ ID NO: 24 - DNA, 1896 bp, Artificial sequence
  Synthetic AacSHC Derivative
atggctgagcagttggtggaagctccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgttcacgcggaggtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacaccccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggcttcccaggggatttctacctcggctacaccatgtaccgccacgtgtttccgacgctcgcgctcggccgctacaagcaagccatcgagcgcaggtga

SEQ ID NO: 25 - protein, 631 aa, Artificial sequence; identical to SEQ ID NO: 19
  Synthetic AacSHC Derivative

SEQ ID NO: 26 - DNA, 1896 bp, Artificial sequence; identical to SEQ ID NO: 20
  Synthetic AacSHC Derivative

SEQ ID NO: 27 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGAWALYPGGPPDLDTTVEAYVALKYIGMSRDEEPMQKALRFIQSQGGIESSRVLTRMWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHIPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGFPGDFYLGYTMYRHVFPTLALGRYKQAIERR

SEQ ID NO: 28 - DNA, 1896 bp, Artificial sequence
  Synthetic AacSHC Derivative
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcgcgtgggccctgtacccgggtgggccgccggacctcgacacgaccgtcgaggcgtacgtcgcgctcaagtatatcggcatgtcgcgcgacgaggagccgatgcagaaggcgctccggttcattcagagccagggcgggatcgagtcgtcgcgcgtgctcacgcggatgtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacatcccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggcttcccaggggatttctacctcggctacaccatgtaccgccacgtgtttccgacgctcgcgctcggccgctacaagcaagccatcgagcgcaggtga

SEQ ID NO: 29 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRMWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHIPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVHYLVETQRPDGGWDEPYYTGTGYPGDFYLGYTMYRHVFPTLALGRYKQAIERR

SEQ ID NO: 30 - DNA, 1896 bp, Artificial sequence
  Synthetic AacSHC Derivative
atggctgagcagttggtggaagcaccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgttcacgcggatgtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacatcccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcattacctcgtggagacgcagcgcccggacggcggctgggatgagccgtactacaccggcacgggctacccaggggatttctacctcggctacaccatgtaccgccacgtgtttccgacgctcgcgctcggccgctacaagcaagccatcgagcgcaggtga

SEQ ID NO: 31 - protein, 631 aa, Artificial sequence; identical to SEQ ID NO: 9
  Synthetic AacSHC Derivative

SEQ ID NO: 32 - DNA, 1896 bp, Artificial sequence; identical to SEQ ID NO: 10
  Synthetic AacSHC Derivative

SEQ ID NO: 33 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVLTRMWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHIPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGYPGDFYLGYTMYRHVFPTLALGRYKQAIERR

SEQ ID NO: 34 - DNA, 1896 bp, Artificial sequence
  Synthetic AacSHC Derivative
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgctcacgcggatgtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacatcccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggctacccaggggatttctacctcggctacaccatgtaccgccacgtgtttccgacgctcgcgctcggccgctacaagcaagccatcgagcgcaggtga

SEQ ID NO: 35 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVLTRRWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHTPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGFPGDFYLGYTMYRHVFPTLALGRYKQAIERR

SEQ ID NO: 36 - DNA, 1896 bp, Artificial sequence
  Synthetic AacSHC Derivative
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgctcacgcggaggtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacaccccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggcttcccaggggatttctacctcggctacaccatgtaccgccacgtgtttccgacgctcgcgctcggccgctacaagcaagccatcgagcgcaggtga

SEQ ID NO: 37 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRRWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHTPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGYPGDFYLGYTMYRHVFPTLALGRYKQAIERR

SEQ ID NO: 38 - DNA, 1896 bp, Artificial sequence
  Synthetic AacSHC Derivative
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgttcacgcggaggtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacaccccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggctacccaggggatttctacctcggctacaccatgtaccgccacgtgtttccgacgctcgcgctcggccgctacaagcaagccatcgagcgcaggtga

SEQ ID NO: 39 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVLTRRWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHTPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGYPGDFYLGYTMYRHVFPTLALGRYKQAIERR

SEQ ID NO: 40 - DNA, 1896 bp, Artificial sequence
  Synthetic AacSHC Derivative
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgctcacgcggaggtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacaccccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggctacccaggggatttctacctcggctacaccatgtaccgccacgtgtttccgacgctcgcgctcggccgctacaagcaagccatcgagcgcaggtga

SEQ ID NO: 41 - protein, 725 aa, Artificial sequence
  Synthetic ZmoSHC1 Derivative
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGAWGVYFGAGNGDINATVEAYAALRSLGYSADNPVLKKAAAWIAEKGGLKNIRVFTRYWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKIPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGFPGYGVGQTIKLDDPALSKRLLQGAELSRAFMLRYDFYRQFFPIMALSRAERLIDLNN

SEQ ID NO: 42 - DNA, 2178 bp, Artificial sequence
  Synthetic ZmoSHC1 Derivative
  misc_feature (387)..(387): n is a, c, g, or t
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggcgcntggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtctttacccgttattggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaattcctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggattccccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 43 - protein, 725 aa, Artificial sequence; identical to SEQ ID NO: 2
  Synthetic ZmoSHC1 Derivative

SEQ ID NO: 44 - DNA, 2178 bp, Artificial sequence
  Synthetic ZmoSHC1 Derivative
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtctttacccgttattggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaattcctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggattccccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 45 - protein, 725 aa, Artificial sequence
  Synthetic ZmoSHC1 Derivative
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVLTRYWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKIPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGFPGYGVGQTIKLDDPALSKRLLQGAELSRAFMLRYDFYRQFFPIMALSRAERLIDLNN

SEQ ID NO: 46 - DNA, 2178 bp, Artificial sequence
  Synthetic ZmoSHC1 Derivative
  misc_feature (544)..(546): ntn is ttr or ctn
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtcntnacccgttattggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaattcctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggattccccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 47 - protein, 725 aa, Artificial sequence
  Synthetic ZmoSHC1 Derivative
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVFTRRWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKIPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGFPGYGVGQTIKLDDPALSKRLLQGAELSRAFMLRYDFYRQFFPIMALSRAERLIDLNN

SEQ ID NO: 48 - DNA, 2178 bp, Artificial sequence
  Synthetic ZmoSHC1 Derivative
  misc_feature (553)..(555): ngn is agr or cgn
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtctttacccgtngntggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaattcctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggattccccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 49 - protein, 725 aa, Artificial sequence
  Synthetic ZmoSHC1 Derivative
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVFTRYWLALIGEWPWEKTPNLPPEIIWFPDNFVFSIYNFAQWARATMVPIAILSARRPSRPLRPQDRLDELFPEGRARFDYELPKKEGIDLWSQFFRTTDRVLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKIPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGFPGYGVGQTIKLDDPALSKRLLQGAELSRAFMLRYDFYRQFFPIMALSRAERLIDLNN

SEQ ID NO: 50 - DNA, 2178 bp, Artificial sequence
  Synthetic ZmoSHC1 Derivative
  misc_feature (846)..(846): n is a, c, g, or t
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtctttacccgttattggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtgtnttacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaattcctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggattccccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 51 - protein, 725 aa, Artificial sequence
  Synthetic ZmoSHC1 Derivative
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVFTRYWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKTPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGFPGYGVGQTIKLDDPALSKRLLQGAELSRAFMLRYDFYRQFFPIMALSRAERLIDLNN

SEQ ID NO: 52 - DNA, 2178 bp, Artificial sequence
  Synthetic ZmoSHC1 Derivative
  misc_feature (1494)..(1494): n is a, c, g, or t
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtctttacccgttattggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaacncctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggattccccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 53 - protein, 725 aa, Artificial sequence; identical to SEQ ID NO: 2
  Synthetic ZmoSHC1 Derivative

SEQ ID NO: 54 - DNA, 2178 bp, Artificial sequence; identical to SEQ ID NO: 44
  Synthetic ZmoSHC1 Derivative

SEQ ID NO: 55 - protein, 725 aa, Artificial sequence
  Synthetic ZmoSHC1 Derivative
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVFTRYWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKIPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGYPGYGVGQTIKLDDPALSKRLLQGAELSRAFMLRYDFYRQFFPIMALSRAERLIDLNN

SEQ ID NO: 56 - DNA, 2178 bp, Artificial sequence
  Synthetic ZmoSHC1 Derivative
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtctttacccgttattggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaattcctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggataycccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 57 - protein, 725 aa, Artificial sequence
  Synthetic ZmoSHC1 Derivative
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVFTRRWLALIGEWPWEKTPNLPPEIIWFPDNFVFSIYNFAQWARATMVPIAILSARRPSRPLRPQDRLDELFPEGRARFDYELPKKEGIDLWSQFFRTTDRVLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKTPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGFPGYGVGQTIKLDDPALSKRLLQGAELSRAFMLRYDFYRQFFPIMALSRAERLIDLNN

SEQ ID NO: 58 - DNA, 2178 bp, Artificial sequence
  Synthetic ZmoSHC1 Derivative
  misc_feature (553)..(555): ngn is agr or cgn
  misc_feature (846)..(846): n is a, c, g, or t
  misc_feature (1494)..(1494): n is a, c, g, or t
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtctttacccgtngntggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtgtnttacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaacncctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggattccccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 59 - protein, 725 aa, Artificial sequence
  Synthetic ZmoSHC1 Derivative
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVFTRRWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKTPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGFPGYGVGQTIKLDDPALSKRLLQGAELSRAFMLRYDFYRQFFPIMALSRAERLIDLNN

SEQ ID NO: 60 - DNA, 2178 bp, Artificial sequence
  Synthetic ZmoSHC1 Derivative
  misc_feature (553)..(555): ngn is agr or cgn
  misc_feature (1494)..(1494): n is a, c, g, or t
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtctttacccgtngntggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaacncctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggattccccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 61 - protein, 725 aa, Artificial sequence; identical to SEQ ID NO: 55
  Synthetic ZmoSHC1 Derivative

SEQ ID NO: 62 - DNA, 2178 bp, Artificial sequence; identical to SEQ ID NO: 56
  Synthetic ZmoSHC1 Derivative

SEQ ID NO: 63 - protein, 725 aa, Artificial sequence
  Synthetic ZmoSHC1 Derivative
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGAWGVYFGAGNGDINATVEAYAALRSLGYSADNPVLKKAAAWIAEKGGLKNIRVLTRYWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKIPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGFPGYGVGQTIKLDDPALSKRLLQGAELSRAFMLRYDFYRQFFPIMALSRAERLIDLNN

SEQ ID NO: 64 - DNA, 2178 bp, Artificial sequence
  Synthetic ZmoSHC1 Derivative
  misc_feature (387)..(387): n is a, c, g, or t
  misc_feature (544)..(546): ntn is ttr or ctn
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggcgcntggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtcntnacccgttattggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaattcctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggattccccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 65 - protein, 725 aa, Artificial sequence; identical to SEQ ID NO: 55
  Synthetic ZmoSHC1 Derivative

SEQ ID NO: 66 - DNA, 2178 bp, Artificial sequence; identical to SEQ ID NO: 56
  Synthetic ZmoSHC1 Derivative

SEQ ID NO: 67 - protein, 725 aa, Artificial sequence; identical to SEQ ID NO: 45
  Synthetic ZmoSHC1 Derivative

SEQ ID NO: 68 - DNA, 2178 bp, Artificial sequence; identical to SEQ ID NO: 46
  Synthetic ZmoSHC1 Derivative
  misc_feature (544)..(546): ntn is ttr or ctn

SEQ ID NO: 69 - protein, 725 aa, Artificial sequence
  Synthetic ZmoSHC1 Derivative
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVLTRYWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKIPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGYPGYGVGQTIKLDDPALSKRLLQGAELSRAFMLRYDFYRQFFPIMALSRAERLIDLNN

SEQ ID NO: 70 - DNA, 2178 bp, Artificial sequence
  Synthetic ZmoSHC1 Derivative
  misc_feature (544)..(546): ntn is ttr or ctn
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtcntnacccgttattggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaattcctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggataycccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 71 - protein, 725 aa, Artificial sequence
  Synthetic ZmoSHC1 Derivative
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVLTRRWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKTPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGFPGYGVGQTIKLDDPALSKRLLQGAELSRAFMLRYDFYRQFFPIMALSRAERLIDLNN

SEQ ID NO: 72 - DNA, 2178 bp, Artificial sequence
  Synthetic ZmoSHC1 Derivative
  misc_feature (544)..(546): ntn is ttr or ctn
  misc_feature (553)..(555): ngn is agr or cgn
  misc_feature (1494)..(1494): n is a, c, g, or t
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtcntnacccgtngntggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaacncctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggattccccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 73 - protein, 725 aa, Artificial sequence
  Synthetic ZmoSHC1 Derivative
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVFTRRWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKTPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGYPGYGVGQTIKLDDPALSKRLLQGAELSRAFMLRYDFYRQFFPIMALSRAERLIDLNN

SEQ ID NO: 74 - DNA, 2178 bp, Artificial sequence
  Synthetic ZmoSHC1 Derivative
  misc_feature (553)..(555): ngn is agr or cgn
  misc_feature (1494)..(1494): n is a, c, g, or t
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtctttacccgtngntggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaacncctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggataycccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 75 - protein, 725 aa, Artificial sequence
  Synthetic ZmoSHC1 Derivative
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVLTRRWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKTPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGYPGYGVGQTIKLDDPALSKRLLQGAELSRAFMLRYDFYRQFFPIMALSRAERLIDLNN

SEQ ID NO: 76 - DNA, 2178 bp, Artificial sequence
  Synthetic ZmoSHC1 Derivative
  misc_feature (544)..(546): ntn is ttr or ctn
  misc_feature (553)..(555): ngn is agr or cgn
  misc_feature (1494)..(1494): n is a, c, g, or t
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtcntnacccgtngntggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaacncctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggataycccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 77 - protein, 658 aa, Artificial sequence
  Synthetic ZmoSHC2 Derivative
MTVSTSSAFHHSPLSDDVEPIIQKATRALLEKQQQDGHWVFELEADATIPAEYILLKHYLGEPEDLEIEAKIGRYLRRIQGEHGAWSLFYGGDLDLSATVKAYFALKMIGDSPDAPHMLRARNEILARGGAMRANVFTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGFPRVFYLRYHGYSKYFPLWALARYRNLKKANQPIVHYGM

SEQ ID NO: 78 - DNA, 1977 bp, Artificial sequence
  Synthetic ZmoSHC2 Derivative
  misc_feature (255)..(255): n is a, c, g, or t
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcgcntggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtctttacacgtattcaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatattccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtataaactggttggcacaaaatcaggatgaagaaggattgtggaaagaagattattatagtggcggtggttttccccgtgttttttatcttcggtatcacggttattccaaatattttcctctttgggctttagcgcgctatcgcaatttgaaaaaagccaatcagccgattgttcattatgggatgtaa

SEQ ID NO: 79 - protein, 658 aa, Artificial sequence; identical to SEQ ID NO: 3
  Synthetic ZmoSHC2 Derivative

SEQ ID NO: 80 - DNA, 1977 bp, Artificial sequence
  Synthetic ZmoSHC2 Derivative
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcggatggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtctttacacgtattcaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatattccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtataaactggttggcacaaaatcaggatgaagaaggattgtggaaagaagattattatagtggcggtggttttccccgtgttttttatcttcggtatcacggttattccaaatattttcctctttgggctttagcgcgctatcgcaatttgaaaaaagccaatcagccgattgttcattatgggatgtaa

SEQ ID NO: 81 - protein, 658 aa, Artificial sequence
  Synthetic ZmoSHC2 Derivative
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVLTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGFPRVFYLRYHGYSKYFPLWALARYRNLKKANQPIVHYGM

SEQ ID NO: 82 - DNA, 1977 bp, Artificial sequence
  Synthetic ZmoSHC2 Derivative
  misc_feature (409)..(411): ntn is ttr or ctn
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcggatggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtcntnacacgtattcaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatattccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtataaactggttggcacaaaatcaggatgaagaaggattgtggaaagaagattattatagtggcggtggttttccccgtgttttttatcttcggtatcacggttattccaaatattttcctctttgggctttagcgcgctatcgcaatttgaaaaaagccaatcagccgattgttcattatgggatgtaa

SEQ ID NO: 83 - protein, 658 aa, Artificial sequence
  Synthetic ZmoSHC2 Derivative
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVFTRRQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGFPRVFYLRYHGYSKYFPLWALARYRNLKKANQPIVHYGM

SEQ ID NO: 84 - DNA, 1977 bp, Artificial sequence
  Synthetic ZmoSHC2 Derivative
  misc_feature (418)..(420): ngn is agr or cgn
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcggatggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtctttacacgtngncaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatattccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtataaactggttggcacaaaatcaggatgaagaaggattgtggaaagaagattattatagtggcggtggttttccccgtgttttttatcttcggtatcacggttattccaaatattttcctctttgggctttagcgcgctatcgcaatttgaaaaaagccaatcagccgattgttcattatgggatgtaa

SEQ ID NO: 85 - protein, 658 aa, Artificial sequence; identical to SEQ ID NO: 3
  Synthetic ZmoSHC2 Derivative

SEQ ID NO: 86 - DNA, 1977 bp, Artificial sequence; identical to SEQ ID NO: 80
  Synthetic ZmoSHC2 Derivative

SEQ ID NO: 87 - protein, 658 aa, Artificial sequence
  Synthetic ZmoSHC2 Derivative
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVFTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNTPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGFPRVFYLRYHGYSKYFPLWALARYRNLKKANQPIVHYGM

SEQ ID NO: 88 - DNA, 1977 bp, Artificial sequence
  Synthetic ZmoSHC2 Derivative
  misc_feature (1350)..(1350): n is a, c, g, or t
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcggatggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtctttacacgtattcaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatacnccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtataaactggttggcacaaaatcaggatgaagaaggattgtggaaagaagattattatagtggcggtggttttccccgtgttttttatcttcggtatcacggttattccaaatattttcctctttgggctttagcgcgctatcgcaatttgaaaaaagccaatcagccgattgttcattatgggatgtaa

SEQ ID NO: 89 - protein, 658 aa, Artificial sequence
  Synthetic ZmoSHC2 Derivative
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVFTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGIHWLAQNQDEEGLWKEDYYSGGGFPRVFYLRYHGYSKYFPLWALARYRNLKKANQPIVHYGM

SEQ ID NO: 90 - DNA, 1977 bp, Artificial sequence
  Synthetic ZmoSHC2 Derivative
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcggatggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtctttacacgtattcaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatattccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtatacaytggttggcacaaaatcaggatgaagaaggattgtggaaagaagattattatagtggcggtggttttccccgtgttttttatcttcggtatcacggttattccaaatattttcctctttgggctttagcgcgctatcgcaatttgaaaaaagccaatcagccgattgttcattatgggatgtaa

SEQ ID NO: 91 - protein, 658 aa, Artificial sequence
  Synthetic ZmoSHC2 Derivative
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVFTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGYPRVFYLRYHGYSKYFPLWALARYRNLKKANQPIVHYGM

SEQ ID NO: 92 - DNA, 1977 bp, Artificial sequence
  Synthetic ZmoSHC2 Derivative
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcggatggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtctttacacgtattcaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatattccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtataaactggttggcacaaaatcaggatgaagaaggattgtggaaagaagattattatagtggcggtggttayccccgtgttttttatcttcggtatcacggttattccaaatattttcctctttgggctttagcgcgctatcgcaatttgaaaaaagccaatcagccgattgttcattatgggatgtaa

SEQ ID NO: 93 - protein, 658 aa, Artificial sequence
  Synthetic ZmoSHC2 Derivative
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVFTRRQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNTPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGFPRVFYLRYHGYSKYFPLWALARYRNLKKANQPIVHYGM

SEQ ID NO: 94 - DNA, 1977 bp, Artificial sequence
  Synthetic ZmoSHC2 Derivative
  misc_feature (418)..(420): ngn is agr or cgn
  misc_feature (1350)..(1350): n is a, c, g, or t
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcggatggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtctttacacgtngncaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatacnccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtataaactggttggcacaaaatcaggatgaagaaggattgtggaaagaagattattatagtggcggtggttttccccgtgttttttatcttcggtatcacggttattccaaatattttcctctttgggctttagcgcgctatcgcaatttgaaaaaagccaatcagccgattgttcattatgggatgtaa

SEQ ID NO: 95 - protein, 658 aa, Artificial sequence; identical to SEQ ID NO: 93
  Synthetic ZmoSHC2 Derivative

SEQ ID NO: 96 - DNA, 1977 bp, Artificial sequence; identical to SEQ ID NO: 94
  Synthetic ZmoSHC2 Derivative
  misc_feature (418)..(420): ngn is agr or cgn
  misc_feature (1350)..(1350): n is a, c, g, or t

SEQ ID NO: 97 - protein, 658 aa, Artificial sequence; identical to SEQ ID NO: 91
  Synthetic ZmoSHC2 Derivative

SEQ ID NO: 98 - DNA, 1977 bp, Artificial sequence; identical to SEQ ID NO: 92
  Synthetic ZmoSHC2 Derivative

SEQ ID NO: 99 - protein, 658 aa, Artificial sequence
  Synthetic ZmoSHC2 Derivative
MTVSTSSAFHHSPLSDDVEPIIQKATRALLEKQQQDGHWVFELEADATIPAEYILLKHYLGEPEDLEIEAKIGRYLRRIQGEHGAWSLFYGGDLDLSATVKAYFALKMIGDSPDAPHMLRARNEILARGGAMRANVLTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGFPRVFYLRYHGYSKYFPLWALARYRNLKKANQPIVHYGM

SEQ ID NO: 100 - DNA, 1977 bp, Artificial sequence
  Synthetic ZmoSHC2 Derivative
  misc_feature (255)..(255): n is a, c, g, or t
  misc_feature (409)..(411): ntn is ttr or ctn
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcgcntggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtcntnacacgtattcaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatattccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtataaactggttggcacaaaatcaggatgaagaaggattgtggaaagaagattattatagtggcggtggttttccccgtgttttttatcttcggtatcacggttattccaaatattttcctctttgggctttagcgcgctatcgcaatttgaaaaaagccaatcagccgattgttcattatgggatgtaa

SEQ ID NO: 101 - protein, 658 aa, Artificial sequence
  Synthetic ZmoSHC2 Derivative
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVFTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGIHWLAQNQDEEGLWKEDYYSGGGYPRVFYLRYHGYSKYFPLWALARYRNLKKANQPIVHYGM

SEQ ID NO: 102 - DNA, 1977 bp, Artificial sequence
  Synthetic ZmoSHC2 Derivative
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcggatggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtctttacacgtattcaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatattccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtatacaytggttggcacaaaatcaggatgaagaaggattgtggaaagaagattattatagtggcggtggttayccccgtgttttttatcttcggtatcacggttattccaaatattttcctctttgggctttagcgcgctatcgcaatttgaaaaaagccaatcagccgattgttcattatgggatgtaa

SEQ ID NO: 103 - protein, 658 aa, Artificial sequence; identical to SEQ ID NO: 81
  Synthetic ZmoSHC2 Derivative

SEQ ID NO: 104 - DNA, 1977 bp, Artificial sequence; identical to SEQ ID NO: 82
  Synthetic ZmoSHC2 Derivative
  misc_feature (409)..(411): ntn is ttr or ctn

SEQ ID NO: 105 - protein, 658 aa, Artificial sequence
  Synthetic ZmoSHC2 Derivative
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVLTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGYPRVFYLRYHGYSKYFPLWALARYRNLKKANQPIVHYGM

SEQ ID NO: 106 - DNA, 1977 bp, Artificial sequence
  Synthetic ZmoSHC2 Derivative
  misc_feature (409)..(411): ntn is ttr or ctn
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcggatggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtcntnacacgtattcaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatattccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtataaactggttggcacaaaatcaggatgaagaaggattgtggaaagaagattattatagtggcggtggttayccccgtgttttttatcttcggtatcacggttattccaaatattttcctctttgggctttagcgcgctatcgcaatttgaaaaaagccaatcagccgattgttcattatgggatgtaa

SEQ ID NO: 107 - protein, 658 aa, Artificial sequence
  Synthetic ZmoSHC2 Derivative
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVLTRRQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNTPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGFPRVFYLRYHGYSKYFPLWALARYRNLKKANQPIVHYGM

SEQ ID NO: 108 - DNA, 1977 bp, Artificial sequence
  Synthetic ZmoSHC2 Derivative
  misc_feature (409)..(411): ntn is ttr or ctn
  misc_feature (418)..(420): ngn is agr or cgn
  misc_feature (1350)..(1350): n is a, c, g, or t
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcggatggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtcntnacacgtngncaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatacnccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtataaactggttggcacaaaatcaggatgaagaaggattgtggaaagaagattattatagtggcggtggttttccccgtgttttttatcttcggtatcacggttattccaaatattttcctctttgggctttagcgcgctatcgcaatttgaaaaaagccaatcagccgattgttcattatgggatgtaa

SEQ ID NO: 109 - protein, 658 aa, Artificial sequence
  Synthetic ZmoSHC2 Derivative
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVFTRRQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNTPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGYPRVFYLRYHGYSKYFPLWALARYRNLKKANQPIVHYGM

SEQ ID NO: 110 - DNA, 1977 bp, Artificial sequence
  Synthetic ZmoSHC2 Derivative
  misc_feature (418)..(420): ngn is agr or cgn
  misc_feature (1350)..(1350): n is a, c, g, or t
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcggatggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtctttacacgtngncaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatacnccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtataaactggttggcacaaaatcaggatgaagaaggattgtggaaagaagattattatagtggcggtggttayccccgtgttttttatcttcggtatcacggttattccaaatattttcctctttgggctttagcgcgctatcgcaatttgaaaaaagccaatcagccgattgttcattatgggatgtaa

SEQ ID NO: 111 - protein, 658 aa, Artificial sequence
  Synthetic ZmoSHC2 Derivative
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVLTRRQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNTPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGYPRVFYLRYHGYSKYFPLWALARYRNLKKANQPIVHYGM

SEQ ID NO: 112 - DNA, 1977 bp, Artificial sequence
  Synthetic ZmoSHC2 Derivative
  misc_feature (409)..(411): ntn is ttr or ctn
  misc_feature (418)..(420): ngn is agr or cgn
  misc_feature (1350)..(1350): n is a, c, g, or t
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcggatggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtcntnacacgtngncaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatacnccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtataaactggttggcacaaaatcaggatgaagaaggattgtggaaagaagattattatagtggcggtggttayccccgtgttttttatcttcggtatcacggttattccaaatattttcctctttgggctttagcgcgctatcgcaatttgaaaaaagccaatcagccgattgttcattatgggatgtaa

SEQ ID NO: 113 - protein, 684 aa, Artificial sequence; identical to SEQ ID NO: 4
  Synthetic BjapSHC1 Derivative

SEQ ID NO: 114 - DNA, 2055 bp, Artificial sequence
  Synthetic BjapSHC1 Derivative
atgactgtgaccagctcggcctccgcgcgtgcgacgcgcgacccgggaaattatcagactgccctgcaatcgacggtgcgcgcggcggcggattggctgatcgccaaccagaagccggacggccattgggtcggccgcgccgagtccaatgcctgcatggaggcgcaatggtgcctcgcgctgtggttcatggggctcgaggaccatccgctgcgcaagcgcctgggccagtcgctgctcgacagccagcgcccggacggcgcctggcaggtctatttcggcgcccccaatggcgacatcaacgcgactgtcgaggcctatgccgcgctccgctcgctgggcttccgcgacgacgagccggcggtgcgccgggcgcgggaatggatcgaggccaagggcggcctgcgcaacatccgcgtcttcacccgctactggctggcactgatcggcgaatggccgtgggagaagacaccgaacatcccgccggaggtgatctggtttccgctctggtttccgttctcgatctacaatttcgcgcaatgggcccgcgccaccttgatgccgatcgccgtgctgtcggcgcggcggccgagccggccgctgccgccggagaaccgcctcgatgcgctgtttccgcatggacggaaggcgttcgactacgaactgccggtcaaggccggcgccggcggctgggacaggttcttccgcggcgccgacaaggttctgcacaagctgcagaacctcggcaaccgtctcaatctcggcctgttccgcccggcggccaccagccgcgtgctggaatggatgatccgccatcaggatttcgacggcgcctggggcggcatccagccgccctggatctacgggctgatggcgctctatgccgaaggctatccgctcaatcatcccgtgctcgcaaagggcctcgacgcgctgaacgatcccggctggcgcgtcgatgtcggtgacgccacctacatccaggccaccaacagcccggtctgggacacgatcctgaccttgctcgccttcgacgatgccggcgtgctcggcgactatcccgaggccgtcgacaaggcggtcgactgggtgctgcagcggcaggtgcgcgtgcccggcgactggtcgatgaagctgccgcatgtcaagcccggcggctgggcgttcgaatacgccaacaactactatcccgacacggacgacaccgcggtcgcgctgatcgcgctggcgccactgcgccacgatccgaaatggaaggccaaagggatcgacgaggctatccagctcggtgtcgactggctgatcggcatgcagagccagggcggcggctggggcgcgttcgacaaggacaacaaccagaagatcctgaccaagatcccgttctgcgattatggcgaggcgctcgatccgccctcggtcgacgtcaccgcccacatcatcgaggcgttcggcaagctcggcatctcgcgcaaccatccgtcgatggtgcaggcgctggactatattcgccgtgagcaggagccgagcggtccgtggttcggccgctggggcgtcaattacgtctacggcaccggcgcggtgctgccggcgctggccgcgatcggcgaggacatgacccagccctatatcggccgcgcctgcgactggctggttgcccatcagcaggccgatggcggctggggcgagagctgcgcctcctacatggatgtcagcgcggtcggccgcggcaccacaacggcctcgcagaccgcctgggcgctgatggcgctgctcgccgccaatcgcccccaggacaaggacgcgatcgagcgtggctgcatgtggctggtcgagcgccagtcggccggcacctgggacgagccggaattcaccggcaccggtttcccgggctacggcgtcggccagaccatcaagctgaacgatcccgcgctgtcgcagcggctgatgcagggcccggaattgtcccgcgccttcatgctccgctacggcatgtaccgccactacttcccgctgatggcgctcggccgcgccctacgcccgcagagtcatagctag

SEQ ID NO: 115 - protein, 684 aa, Artificial sequence; identical to SEQ ID NO: 4
  Synthetic BjapSHC1 Derivative

SEQ ID NO: 116 - DNA, 2055 bp, Artificial sequence; identical to SEQ ID NO: 114
  Synthetic BjapSHC1 Derivative

SEQ ID NO: 117 - protein, 684 aa, Artificial sequence
  Synthetic BjapSHC1 Derivative
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVLTRYWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKIPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCMWLVERQSAGTWDEPEFTGTGFPGYGVGQTIKLNDPALSQRLMQGPELSRAFMLRYGMYRHYFPLMALGRALRPQSHS

SEQ ID NO: 118 - DNA, 2055 bp, Artificial sequence
  Synthetic BjapSHC1 Derivative
  misc_feature (421)..(423): ntn is ttr or ctn
atgactgtgaccagctcggcctccgcgcgtgcgacgcgcgacccgggaaattatcagactgccctgcaatcgacggtgcgcgcggcggcggattggctgatcgccaaccagaagccggacggccattgggtcggccgcgccgagtccaatgcctgcatggaggcgcaatggtgcctcgcgctgtggttcatggggctcgaggaccatccgctgcgcaagcgcctgggccagtcgctgctcgacagccagcgcccggacggcgcctggcaggtctatttcggcgcccccaatggcgacatcaacgcgactgtcgaggcctatgccgcgctccgctcgctgggcttccgcgacgacgagccggcggtgcgccgggcgcgggaatggatcgaggccaagggcggcctgcgcaacatccgcgtcntnacccgctactggctggcactgatcggcgaatggccgtgggagaagacaccgaacatcccgccggaggtgatctggtttccgctctggtttccgttctcgatctacaatttcgcgcaatgggcccgcgccaccttgatgccgatcgccgtgctgtcggcgcggcggccgagccggccgctgccgccggagaaccgcctcgatgcgctgtttccgcatggacggaaggcgttcgactacgaactgccggtcaaggccggcgccggcggctgggacaggttcttccgcggcgccgacaaggttctgcacaagctgcagaacctcggcaaccgtctcaatctcggcctgttccgcccggcggccaccagccgcgtgctggaatggatgatccgccatcaggatttcgacggcgcctggggcggcatccagccgccctggatctacgggctgatggcgctctatgccgaaggctatccgctcaatcatcccgtgctcgcaaagggcctcgacgcgctgaacgatcccggctggcgcgtcgatgtcggtgacgccacctacatccaggccaccaacagcccggtctgggacacgatcctgaccttgctcgccttcgacgatgccggcgtgctcggcgactatcccgaggccgtcgacaaggcggtcgactgggtgctgcagcggcaggtgcgcgtgcccggcgactggtcgatgaagctgccgcatgtcaagcccggcggctgggcgttcgaatacgccaacaactactatcccgacacggacgacaccgcggtcgcgctgatcgcgctggcgccactgcgccacgatccgaaatggaaggccaaagggatcgacgaggctatccagctcggtgtcgactggctgatcggcatgcagagccagggcggcggctggggcgcgttcgacaaggacaacaaccagaagatcctgaccaagatcccgttctgcgattatggcgaggcgctcgatccgccctcggtcgacgtcaccgcccacatcatcgaggcgttcggcaagctcggcatctcgcgcaaccatccgtcgatggtgcaggcgctggactatattcgccgtgagcaggagccgagcggtccgtggttcggccgctggggcgtcaattacgtctacggcaccggcgcggtgctgccggcgctggccgcgatcggcgaggacatgacccagccctatatcggccgcgcctgcgactggctggttgcccatcagcaggccgatggcggctggggcgagagctgcgcctcctacatggatgtcagcgcggtcggccgcggcaccacaacggcctcgcagaccgcctgggcgctgatggcgctgctcgccgccaatcgcccccaggacaaggacgcgatcgagcgtggctgcatgtggctggtcgagcgccagtcggccggcacctgggacgagccggaattcaccggcaccggtttcccgggctacggcgtcggccagaccatcaagctgaacgatcccgcgctgtcgcagcggctgatgcagggcccggaattgtcccgcgccttcatgctccgctacggcatgtaccgccactacttcccgctgatggcgctcggccgcgccctacgcccgcagagtcatagctag

SEQ ID NO: 119 - protein, 684 aa, Artificial sequence
  Synthetic BjapSHC1 Derivative
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVFTRRWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKIPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCMWLVERQSAGTWDEPEFTGTGFPGYGVGQTIKLNDPALSQRLMQGPELSRAFMLRYGMYRHYFPLMALGRALRPQSHS

SEQ ID NO: 120 - DNA, 2055 bp, Artificial sequence
  Synthetic BjapSHC1 Derivative
  misc_feature (430)..(432): ngn is agr or cgn
atgactgtgaccagctcggcctccgcgcgtgcgacgcgcgacccgggaaattatcagactgccctgcaatcgacggtgcgcgcggcggcggattggctgatcgccaaccagaagccggacggccattgggtcggccgcgccgagtccaatgcctgcatggaggcgcaatggtgcctcgcgctgtggttcatggggctcgaggaccatccgctgcgcaagcgcctgggccagtcgctgctcgacagccagcgcccggacggcgcctggcaggtctatttcggcgcccccaatggcgacatcaacgcgactgtcgaggcctatgccgcgctccgctcgctgggcttccgcgacgacgagccggcggtgcgccgggcgcgggaatggatcgaggccaagggcggcctgcgcaacatccgcgtcttcacccgcngntggctggcactgatcggcgaatggccgtgggagaagacaccgaacatcccgccggaggtgatctggtttccgctctggtttccgttctcgatctacaatttcgcgcaatgggcccgcgccaccttgatgccgatcgccgtgctgtcggcgcggcggccgagccggccgctgccgccggagaaccgcctcgatgcgctgtttccgcatggacggaaggcgttcgactacgaactgccggtcaaggccggcgccggcggctgggacaggttcttccgcggcgccgacaaggttctgcacaagctgcagaacctcggcaaccgtctcaatctcggcctgttccgcccggcggccaccagccgcgtgctggaatggatgatccgccatcaggatttcgacggcgcctggggcggcatccagccgccctggatctacgggctgatggcgctctatgccgaaggctatccgctcaatcatcccgtgctcgcaaagggcctcgacgcgctgaacgatcccggctggcgcgtcgatgtcggtgacgccacctacatccaggccaccaacagcccggtctgggacacgatcctgaccttgctcgccttcgacgatgccggcgtgctcggcgactatcccgaggccgtcgacaaggcggtcgactgggtgctgcagcggcaggtgcgcgtgcccggcgactggtcgatgaagctgccgcatgtcaagcccggcggctgggcgttcgaatacgccaacaactactatcccgacacggacgacaccgcggtcgcgctgatcgcgctggcgccactgcgccacgatccgaaatggaaggccaaagggatcgacgaggctatccagctcggtgtcgactggctgatcggcatgcagagccagggcggcggctggggcgcgttcgacaaggacaacaaccagaagatcctgaccaagatcccgttctgcgattatggcgaggcgctcgatccgccctcggtcgacgtcaccgcccacatcatcgaggcgttcggcaagctcggcatctcgcgcaaccatccgtcgatggtgcaggcgctggactatattcgccgtgagcaggagccgagcggtccgtggttcggccgctggggcgtcaattacgtctacggcaccggcgcggtgctgccggcgctggccgcgatcggcgaggacatgacccagccctatatcggccgcgcctgcgactggctggttgcccatcagcaggccgatggcggctggggcgagagctgcgcctcctacatggatgtcagcgcggtcggccgcggcaccacaacggcctcgcagaccgcctgggcgctgatggcgctgctcgccgccaatcgcccccaggacaaggacgcgatcgagcgtggctgcatgtggctggtcgagcgccagtcggccggcacctgggacgagccggaattcaccggcaccggtttcccgggctacggcgtcggccagaccatcaagctgaacgatcccgcgctgtcgcagcggctgatgcagggcccggaattgtcccgcgccttcatgctccgctacggcatgtaccgccactacttcccgctgatggcgctcggccgcgccctacgcccgcagagtcatagctag

SEQ ID NO: 121 - protein, 684 aa, Artificial sequence; identical to SEQ ID NO: 4
  Synthetic BjapSHC1 Derivative

SEQ ID NO: 122 - DNA, 2055 bp, Artificial sequence; identical to SEQ ID NO: 114
  Synthetic BjapSHC1 Derivative

SEQ ID NO: 123 - protein, 684 aa, Artificial sequence
  Synthetic BjapSHC1 Derivative
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVFTRYWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKTPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCMWLVERQSAGTWDEPEFTGTGFPGYGVGQTIKLNDPALSQRLMQGPELSRAFMLRYGMYRHYFPLMALGRALRPQSHS

SEQ ID NO: 124 - DNA, 2055 bp, Artificial sequence
  Synthetic BjapSHC1 Derivative
  misc_feature (1377)..(1377): n is a, c, g, or t
atgactgtgaccagctcggcctccgcgcgtgcgacgcgcgacccgggaaattatcagactgccctgcaatcgacggtgcgcgcggcggcggattggctgatcgccaaccagaagccggacggccattgggtcggccgcgccgagtccaatgcctgcatggaggcgcaatggtgcctcgcgctgtggttcatggggctcgaggaccatccgctgcgcaagcgcctgggccagtcgctgctcgacagccagcgcccggacggcgcctggcaggtctatttcggcgcccccaatggcgacatcaacgcgactgtcgaggcctatgccgcgctccgctcgctgggcttccgcgacgacgagccggcggtgcgccgggcgcgggaatggatcgaggccaagggcggcctgcgcaacatccgcgtcttcacccgctactggctggcactgatcggcgaatggccgtgggagaagacaccgaacatcccgccggaggtgatctggtttccgctctggtttccgttctcgatctacaatttcgcgcaatgggcccgcgccaccttgatgccgatcgccgtgctgtcggcgcggcggccgagccggccgctgccgccggagaaccgcctcgatgcgctgtttccgcatggacggaaggcgttcgactacgaactgccggtcaaggccggcgccggcggctgggacaggttcttccgcggcgccgacaaggttctgcacaagctgcagaacctcggcaaccgtctcaatctcggcctgttccgcccggcggccaccagccgcgtgctggaatggatgatccgccatcaggatttcgacggcgcctggggcggcatccagccgccctggatctacgggctgatggcgctctatgccgaaggctatccgctcaatcatcccgtgctcgcaaagggcctcgacgcgctgaacgatcccggctggcgcgtcgatgtcggtgacgccacctacatccaggccaccaacagcccggtctgggacacgatcctgaccttgctcgccttcgacgatgccggcgtgctcggcgactatcccgaggccgtcgacaaggcggtcgactgggtgctgcagcggcaggtgcgcgtgcccggcgactggtcgatgaagctgccgcatgtcaagcccggcggctgggcgttcgaatacgccaacaactactatcccgacacggacgacaccgcggtcgcgctgatcgcgctggcgccactgcgccacgatccgaaatggaaggccaaagggatcgacgaggctatccagctcggtgtcgactggctgatcggcatgcagagccagggcggcggctggggcgcgttcgacaaggacaacaaccagaagatcctgaccaagacnccgttctgcgattatggcgaggcgctcgatccgccctcggtcgacgtcaccgcccacatcatcgaggcgttcggcaagctcggcatctcgcgcaaccatccgtcgatggtgcaggcgctggactatattcgccgtgagcaggagccgagcggtccgtggttcggccgctggggcgtcaattacgtctacggcaccggcgcggtgctgccggcgctggccgcgatcggcgaggacatgacccagccctatatcggccgcgcctgcgactggctggttgcccatcagcaggccgatggcggctggggcgagagctgcgcctcctacatggatgtcagcgcggtcggccgcggcaccacaacggcctcgcagaccgcctgggcgctgatggcgctgctcgccgccaatcgcccccaggacaaggacgcgatcgagcgtggctgcatgtggctggtcgagcgccagtcggccggcacctgggacgagccggaattcaccggcaccggtttcccgggctacggcgtcggccagaccatcaagctgaacgatcccgcgctgtcgcagcggctgatgcagggcccggaattgtcccgcgccttcatgctccgctacggcatgtaccgccactacttcccgctgatggcgctcggccgcgccctacgcccgcagagtcatagctag

SEQ ID NO: 125 - protein, 684 aa, Artificial sequence
  Synthetic BjapSHC1 Derivative
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVFTRYWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKIPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCHWLVERQSAGTWDEPEFTGTGFPGYGVGQTIKLNDPALSQRLMQGPELSRAFMLRYGMYRHYFPLMALGRALRPQSHS

SEQ ID NO: 126 - DNA, 2055 bp, Artificial sequence
  Synthetic BjapSHC1 Derivative
atgactgtgaccagctcggcctccgcgcgtgcgacgcgcgacccgggaaattatcagactgccctgcaatcgacggtgcgcgcggcggcggattggctgatcgccaaccagaagccggacggccattgggtcggccgcgccgagtccaatgcctgcatggaggcgcaatggtgcctcgcgctgtggttcatggggctcgaggaccatccgctgcgcaagcgcctgggccagtcgctgctcgacagccagcgcccggacggcgcctggcaggtctatttcggcgcccccaatggcgacatcaacgcgactgtcgaggcctatgccgcgctccgctcgctgggcttccgcgacgacgagccggcggtgcgccgggcgcgggaatggatcgaggccaagggcggcctgcgcaacatccgcgtcttcacccgctactggctggcactgatcggcgaatggccgtgggagaagacaccgaacatcccgccggaggtgatctggtttccgctctggtttccgttctcgatctacaatttcgcgcaatgggcccgcgccaccttgatgccgatcgccgtgctgtcggcgcggcggccgagccggccgctgccgccggagaaccgcctcgatgcgctgtttccgcatggacggaaggcgttcgactacgaactgccggtcaaggccggcgccggcggctgggacaggttcttccgcggcgccgacaaggttctgcacaagctgcagaacctcggcaaccgtctcaatctcggcctgttccgcccggcggccaccagccgcgtgctggaatggatgatccgccatcaggatttcgacggcgcctggggcggcatccagccgccctggatctacgggctgatggcgctctatgccgaaggctatccgctcaatcatcccgtgctcgcaaagggcctcgacgcgctgaacgatcccggctggcgcgtcgatgtcggtgacgccacctacatccaggccaccaacagcccggtctgggacacgatcctgaccttgctcgccttcgacgatgccggcgtgctcggcgactatcccgaggccgtcgacaaggcggtcgactgggtgctgcagcggcaggtgcgcgtgcccggcgactggtcgatgaagctgccgcatgtcaagcccggcggctgggcgttcgaatacgccaacaactactatcccgacacggacgacaccgcggtcgcgctgatcgcgctggcgccactgcgccacgatccgaaatggaaggccaaagggatcgacgaggctatccagctcggtgtcgactggctgatcggcatgcagagccagggcggcggctggggcgcgttcgacaaggacaacaaccagaagatcctgaccaagatcccgttctgcgattatggcgaggcgctcgatccgccctcggtcgacgtcaccgcccacatcatcgaggcgttcggcaagctcggcatctcgcgcaaccatccgtcgatggtgcaggcgctggactatattcgccgtgagcaggagccgagcggtccgtggttcggccgctggggcgtcaattacgtctacggcaccggcgcggtgctgccggcgctggccgcgatcggcgaggacatgacccagccctatatcggccgcgcctgcgactggctggttgcccatcagcaggccgatggcggctggggcgagagctgcgcctcctacatggatgtcagcgcggtcggccgcggcaccacaacggcctcgcagaccgcctgggcgctgatggcgctgctcgccgccaatcgcccccaggacaaggacgcgatcgagcgtggctgccaytggctggtcgagcgccagtcggccggcacctgggacgagccggaattcaccggcaccggtttcccgggctacggcgtcggccagaccatcaagctgaacgatcccgcgctgtcgcagcggctgatgcagggcccggaattgtcccgcgccttcatgctccgctacggcatgtaccgccactacttcccgctgatggcgctcggccgcgccctacgcccgcagagtcatagctag

SEQ ID NO: 127 - protein, 684 aa, Artificial sequence
  Synthetic BjapSHC1 Derivative
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVFTRYWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKIPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCMWLVERQSAGTWDEPEFTGTGYPGYGVGQTIKLNDPALSQRLMQGPELSRAFMLRYGMYRHYFPLMALGRALRPQSHS

SEQ ID NO: 128 - DNA, 2055 bp, Artificial sequence
  Synthetic BjapSHC1 Derivative
atgactgtgaccagctcggcctccgcgcgtgcgacgcgcgacccgggaaattatcagactgccctgcaatcgacggtgcgcgcggcggcggattggctgatcgccaaccagaagccggacggccattgggtcggccgcgccgagtccaatgcctgcatggaggcgcaatggtgcctcgcgctgtggttcatggggctcgaggaccatccgctgcgcaagcgcctgggccagtcgctgctcgacagccagcgcccggacggcgcctggcaggtctatttcggcgcccccaatggcgacatcaacgcgactgtcgaggcctatgccgcgctccgctcgctgggcttccgcgacgacgagccggcggtgcgccgggcgcgggaatggatcgaggccaagggcggcctgcgcaacatccgcgtcttcacccgctactggctggcactgatcggcgaatggccgtgggagaagacaccgaacatcccgccggaggtgatctggtttccgctctggtttccgttctcgatctacaatttcgcgcaatgggcccgcgccaccttgatgccgatcgccgtgctgtcggcgcggcggccgagccggccgctgccgccggagaaccgcctcgatgcgctgtttccgcatggacggaaggcgttcgactacgaactgccggtcaaggccggcgccggcggctgggacaggttcttccgcggcgccgacaaggttctgcacaagctgcagaacctcggcaaccgtctcaatctcggcctgttccgcccggcggccaccagccgcgtgctggaatggatgatccgccatcaggatttcgacggcgcctggggcggcatccagccgccctggatctacgggctgatggcgctctatgccgaaggctatccgctcaatcatcccgtgctcgcaaagggcctcgacgcgctgaacgatcccggctggcgcgtcgatgtcggtgacgccacctacatccaggccaccaacagcccggtctgggacacgatcctgaccttgctcgccttcgacgatgccggcgtgctcggcgactatcccgaggccgtcgacaaggcggtcgactgggtgctgcagcggcaggtgcgcgtgcccggcgactggtcgatgaagctgccgcatgtcaagcccggcggctgggcgttcgaatacgccaacaactactatcccgacacggacgacaccgcggtcgcgctgatcgcgctggcgccactgcgccacgatccgaaatggaaggccaaagggatcgacgaggctatccagctcggtgtcgactggctgatcggcatgcagagccagggcggcggctggggcgcgttcgacaaggacaacaaccagaagatcctgaccaagatcccgttctgcgattatggcgaggcgctcgatccgccctcggtcgacgtcaccgcccacatcatcgaggcgttcggcaagctcggcatctcgcgcaaccatccgtcgatggtgcaggcgctggactatattcgccgtgagcaggagccgagcggtccgtggttcggccgctggggcgtcaattacgtctacggcaccggcgcggtgctgccggcgctggccgcgatcggcgaggacatgacccagccctatatcggccgcgcctgcgactggctggttgcccatcagcaggccgatggcggctggggcgagagctgcgcctcctacatggatgtcagcgcggtcggccgcggcaccacaacggcctcgcagaccgcctgggcgctgatggcgctgctcgccgccaatcgcccccaggacaaggacgcgatcgagcgtggctgcatgtggctggtcgagcgccagtcggccggcacctgggacgagccggaattcaccggcaccggttayccgggctacggcgtcggccagaccatcaagctgaacgatcccgcgctgtcgcagcggctgatgcagggcccggaattgtcccgcgccttcatgctccgctacggcatgtaccgccactacttcccgctgatggcgctcggccgcgccctacgcccgcagagtcatagctag

SEQ ID NO: 129 - protein, 684 aa, Artificial sequence
  Synthetic BjapSHC1 Derivative
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVFTRRWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKTPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCMWLVERQSAGTWDEPEFTGTGFPGYGVGQTIKLNDPALSQRLMQGPELSRAFMLRYGMYRHYFPLMALGRALRPQSHS

SEQ ID NO: 130 - DNA, 2055 bp, Artificial sequence
  Synthetic BjapSHC1 Derivative
  misc_feature (430)..(432): ngn is agr or cgn
  misc_feature (1377)..(1377): n is a, c, g, or t
atgactgtgaccagctcggcctccgcgcgtgcgacgcgcgacccgggaaattatcagactgccctgcaatcgacggtgcgcgcggcggcggattggctgatcgccaaccagaagccggacggccattgggtcggccgcgccgagtccaatgcctgcatggaggcgcaatggtgcctcgcgctgtggttcatggggctcgaggaccatccgctgcgcaagcgcctgggccagtcgctgctcgacagccagcgcccggacggcgcctggcaggtctatttcggcgcccccaatggcgacatcaacgcgactgtcgaggcctatgccgcgctccgctcgctgggcttccgcgacgacgagccggcggtgcgccgggcgcgggaatggatcgaggccaagggcggcctgcgcaacatccgcgtcttcacccgcngntggctggcactgatcggcgaatggccgtgggagaagacaccgaacatcccgccggaggtgatctggtttccgctctggtttccgttctcgatctacaatttcgcgcaatgggcccgcgccaccttgatgccgatcgccgtgctgtcggcgcggcggccgagccggccgctgccgccggagaaccgcctcgatgcgctgtttccgcatggacggaaggcgttcgactacgaactgccggtcaaggccggcgccggcggctgggacaggttcttccgcggcgccgacaaggttctgcacaagctgcagaacctcggcaaccgtctcaatctcggcctgttccgcccggcggccaccagccgcgtgctggaatggatgatccgccatcaggatttcgacggcgcctggggcggcatccagccgccctggatctacgggctgatggcgctctatgccgaaggctatccgctcaatcatcccgtgctcgcaaagggcctcgacgcgctgaacgatcccggctggcgcgtcgatgtcggtgacgccacctacatccaggccaccaacagcccggtctgggacacgatcctgaccttgctcgccttcgacgatgccggcgtgctcggcgactatcccgaggccgtcgacaaggcggtcgactgggtgctgcagcggcaggtgcgcgtgcccggcgactggtcgatgaagctgccgcatgtcaagcccggcggctgggcgttcgaatacgccaacaactactatcccgacacggacgacaccgcggtcgcgctgatcgcgctggcgccactgcgccacgatccgaaatggaaggccaaagggatcgacgaggctatccagctcggtgtcgactggctgatcggcatgcagagccagggcggcggctggggcgcgttcgacaaggacaacaaccagaagatcctgaccaagacnccgttctgcgattatggcgaggcgctcgatccgccctcggtcgacgtcaccgcccacatcatcgaggcgttcggcaagctcggcatctcgcgcaaccatccgtcgatggtgcaggcgctggactatattcgccgtgagcaggagccgagcggtccgtggttcggccgctggggcgtcaattacgtctacggcaccggcgcggtgctgccggcgctggccgcgatcggcgaggacatgacccagccctatatcggccgcgcctgcgactggctggttgcccatcagcaggccgatggcggctggggcgagagctgcgcctcctacatggatgtcagcgcggtcggccgcggcaccacaacggcctcgcagaccgcctgggcgctgatggcgctgctcgccgccaatcgcccccaggacaaggacgcgatcgagcgtggctgcatgtggctggtcgagcgccagtcggccggcacctgggacgagccggaattcaccggcaccggtttcccgggctacggcgtcggccagaccatcaagctgaacgatcccgcgctgtcgcagcggctgatgcagggcccggaattgtcccgcgccttcatgctccgctacggcatgtaccgccactacttcccgctgatggcgctcggccgcgccctacgcccgcagagtcatagctag

SEQ ID NO: 131 - protein, 684 aa, Artificial sequence; identical to SEQ ID NO: 129
  Synthetic BjapSHC1 Derivative

SEQ ID NO: 132 - DNA, 2055 bp, Artificial sequence; identical to SEQ ID NO: 130
  Synthetic BjapSHC1 Derivative
  misc_feature (430)..(432): ngn is agr or cgn
  misc_feature (1377)..(1377): n is a, c, g, or t

SEQ ID NO: 133 - protein, 684 aa, Artificial sequence; identical to SEQ ID NO: 127
  Synthetic BjapSHC1 Derivative

SEQ ID NO: 134 - DNA, 2055 bp, Artificial sequence; identical to SEQ ID NO: 128
  Synthetic BjapSHC1 Derivative

SEQ ID NO: 135 - protein, 684 aa, Artificial sequence; identical to SEQ ID NO: 117
  Synthetic BjapSHC1 Derivative

SEQ ID NO: 136 - DNA, 2055 bp, Artificial sequence; identical to SEQ ID NO: 118
  Synthetic BjapSHC1 Derivative
  misc_feature (421)..(423): ntn is ttr or ctn

SEQ ID NO: 137 - protein, 684 aa, Artificial sequence
  Synthetic BjapSHC1 Derivative
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVFTRYWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKIPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCHWLVERQSAGTWDEPEFTGTGYPGYGVGQTIKLNDPALSQRLMQGPELSRAFMLRYGMYRHYFPLMALGRALRPQSHS

SEQ ID NO: 138 - DNA, 2055 bp, Artificial sequence
  Synthetic BjapSHC1 Derivative
atgactgtgaccagctcggcctccgcgcgtgcgacgcgcgacccgggaaattatcagactgccctgcaatcgacggtgcgcgcggcggcggattggctgatcgccaaccagaagccggacggccattgggtcggccgcgccgagtccaatgcctgcatggaggcgcaatggtgcctcgcgctgtggttcatggggctcgaggaccatccgctgcgcaagcgcctgggccagtcgctgctcgacagccagcgcccggacggcgcctggcaggtctatttcggcgcccccaatggcgacatcaacgcgactgtcgaggcctatgccgcgctccgctcgctgggcttccgcgacgacgagccggcggtgcgccgggcgcgggaatggatcgaggccaagggcggcctgcgcaacatccgcgtcttcacccgctactggctggcactgatcggcgaatggccgtgggagaagacaccgaacatcccgccggaggtgatctggtttccgctctggtttccgttctcgatctacaatttcgcgcaatgggcccgcgccaccttgatgccgatcgccgtgctgtcggcgcggcggccgagccggccgctgccgccggagaaccgcctcgatgcgctgtttccgcatggacggaaggcgttcgactacgaactgccggtcaaggccggcgccggcggctgggacaggttcttccgcggcgccgacaaggttctgcacaagctgcagaacctcggcaaccgtctcaatctcggcctgttccgcccggcggccaccagccgcgtgctggaatggatgatccgccatcaggatttcgacggcgcctggggcggcatccagccgccctggatctacgggctgatggcgctctatgccgaaggctatccgctcaatcatcccgtgctcgcaaagggcctcgacgcgctgaacgatcccggctggcgcgtcgatgtcggtgacgccacctacatccaggccaccaacagcccggtctgggacacgatcctgaccttgctcgccttcgacgatgccggcgtgctcggcgactatcccgaggccgtcgacaaggcggtcgactgggtgctgcagcggcaggtgcgcgtgcccggcgactggtcgatgaagctgccgcatgtcaagcccggcggctgggcgttcgaatacgccaacaactactatcccgacacggacgacaccgcggtcgcgctgatcgcgctggcgccactgcgccacgatccgaaatggaaggccaaagggatcgacgaggctatccagctcggtgtcgactggctgatcggcatgcagagccagggcggcggctggggcgcgttcgacaaggacaacaaccagaagatcctgaccaagatcccgttctgcgattatggcgaggcgctcgatccgccctcggtcgacgtcaccgcccacatcatcgaggcgttcggcaagctcggcatctcgcgcaaccatccgtcgatggtgcaggcgctggactatattcgccgtgagcaggagccgagcggtccgtggttcggccgctggggcgtcaattacgtctacggcaccggcgcggtgctgccggcgctggccgcgatcggcgaggacatgacccagccctatatcggccgcgcctgcgactggctggttgcccatcagcaggccgatggcggctggggcgagagctgcgcctcctacatggatgtcagcgcggtcggccgcggcaccacaacggcctcgcagaccgcctgggcgctgatggcgctgctcgccgccaatcgcccccaggacaaggacgcgatcgagcgtggctgccaytggctggtcgagcgccagtcggccggcacctgggacgagccggaattcaccggcaccggttayccgggctacggcgtcggccagaccatcaagctgaacgatcccgcgctgtcgcagcggctgatgcagggcccggaattgtcccgcgccttcatgctccgctacggcatgtaccgccactacttcccgctgatggcgctcggccgcgccctacgcccgcagagtcatagctag

SEQ ID NO: 139 - protein, 684 aa, Artificial sequence; identical to SEQ ID NO: 117
  Synthetic BjapSHC1 Derivative

SEQ ID NO: 140 - DNA, 2055 bp, Artificial sequence; identical to SEQ ID NO: 118
  Synthetic BjapSHC1 Derivative
  misc_feature (421)..(423): ntn is ttr or ctn

SEQ ID NO: 141 - protein, 684 aa, Artificial sequence
  Synthetic BjapSHC1 Derivative
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVLTRYWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKIPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCMWLVERQSAGTWDEPEFTGTGYPGYGVGQTIKLNDPALSQRLMQGPELSRAFMLRYGMYRHYFPLMALGRALRPQSHS

SEQ ID NO: 142 - DNA, 2055 bp, Artificial sequence
  Synthetic BjapSHC1 Derivative
  misc_feature (421)..(423): ntn is ttr or ctn
atgactgtgaccagctcggcctccgcgcgtgcgacgcgcgacccgggaaattatcagactgccctgcaatcgacggtgcgcgcggcggcggattggctgatcgccaaccagaagccggacggccattgggtcggccgcgccgagtccaatgcctgcatggaggcgcaatggtgcctcgcgctgtggttcatggggctcgaggaccatccgctgcgcaagcgcctgggccagtcgctgctcgacagccagcgcccggacggcgcctggcaggtctatttcggcgcccccaatggcgacatcaacgcgactgtcgaggcctatgccgcgctccgctcgctgggcttccgcgacgacgagccggcggtgcgccgggcgcgggaatggatcgaggccaagggcggcctgcgcaacatccgcgtcntnacccgctactggctggcactgatcggcgaatggccgtgggagaagacaccgaacatcccgccggaggtgatctggtttccgctctggtttccgttctcgatctacaatttcgcgcaatgggcccgcgccaccttgatgccgatcgccgtgctgtcggcgcggcggccgagccggccgctgccgccggagaaccgcctcgatgcgctgtttccgcatggacggaaggcgttcgactacgaactgccggtcaaggccggcgccggcggctgggacaggttcttccgcggcgccgacaaggttctgcacaagctgcagaacctcggcaaccgtctcaatctcggcctgttccgcccggcggccaccagccgcgtgctggaatggatgatccgccatcaggatttcgacggcgcctggggcggcatccagccgccctggatctacgggctgatggcgctctatgccgaaggctatccgctcaatcatcccgtgctcgcaaagggcctcgacgcgctgaacgatcccggctggcgcgtcgatgtcggtgacgccacctacatccaggccaccaacagcccggtctgggacacgatcctgaccttgctcgccttcgacgatgccggcgtgctcggcgactatcccgaggccgtcgacaaggcggtcgactgggtgctgcagcggcaggtgcgcgtgcccggcgactggtcgatgaagctgccgcatgtcaagcccggcggctgggcgttcgaatacgccaacaactactatcccgacacggacgacaccgcggtcgcgctgatcgcgctggcgccactgcgccacgatccgaaatggaaggccaaagggatcgacgaggctatccagctcggtgtcgactggctgatcggcatgcagagccagggcggcggctggggcgcgttcgacaaggacaacaaccagaagatcctgaccaagatcccgttctgcgattatggcgaggcgctcgatccgccctcggtcgacgtcaccgcccacatcatcgaggcgttcggcaagctcggcatctcgcgcaaccatccgtcgatggtgcaggcgctggactatattcgccgtgagcaggagccgagcggtccgtggttcggccgctggggcgtcaattacgtctacggcaccggcgcggtgctgccggcgctggccgcgatcggcgaggacatgacccagccctatatcggccgcgcctgcgactggctggttgcccatcagcaggccgatggcggctggggcgagagctgcgcctcctacatggatgtcagcgcggtcggccgcggcaccacaacggcctcgcagaccgcctgggcgctgatggcgctgctcgccgccaatcgcccccaggacaaggacgcgatcgagcgtggctgcatgtggctggtcgagcgccagtcggccggcacctgggacgagccggaattcaccggcaccggttayccgggctacggcgtcggccagaccatcaagctgaacgatcccgcgctgtcgcagcggctgatgcagggcccggaattgtcccgcgccttcatgctccgctacggcatgtaccgccactacttcccgctgatggcgctcggccgcgccctacgcccgcagagtcatagctag

SEQ ID NO: 143 - protein, 684 aa, Artificial sequence
  Synthetic BjapSHC1 Derivative
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVLTRRWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKTPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCMWLVERQSAGTWDEPEFTGTGFPGYGVGQTIKLNDPALSQRLMQGPELSRAFMLRYGMYRHYFPLMALGRALRPQSHS

SEQ ID NO: 144 - DNA, 2055 bp, Artificial sequence
  Synthetic BjapSHC1 Derivative
  misc_feature (421)..(423): ntn is ttr or ctn
  misc_feature (430)..(432): ngn is agr or cgn
  misc_feature (1377)..(1377): n is a, c, g, or t
atgactgtgaccagctcggcctccgcgcgtgcgacgcgcgacccgggaaattatcagactgccctgcaatcgacggtgcgcgcggcggcggattggctgatcgccaaccagaagccggacggccattgggtcggccgcgccgagtccaatgcctgcatggaggcgcaatggtgcctcgcgctgtggttcatggggctcgaggaccatccgctgcgcaagcgcctgggccagtcgctgctcgacagccagcgcccggacggcgcctggcaggtctatttcggcgcccccaatggcgacatcaacgcgactgtcgaggcctatgccgcgctccgctcgctgggcttccgcgacgacgagccggcggtgcgccgggcgcgggaatggatcgaggccaagggcggcctgcgcaacatccgcgtcntnacccgcngntggctggcactgatcggcgaatggccgtgggagaagacaccgaacatcccgccggaggtgatctggtttccgctctggtttccgttctcgatctacaatttcgcgcaatgggcccgcgccaccttgatgccgatcgccgtgctgtcggcgcggcggccgagccggccgctgccgccggagaaccgcctcgatgcgctgtttccgcatggacggaaggcgttcgactacgaactgccggtcaaggccggcgccggcggctgggacaggttcttccgcggcgccgacaaggttctgcacaagctgcagaacctcggcaaccgtctcaatctcggcctgttccgcccggcggccaccagccgcgtgctggaatggatgatccgccatcaggatttcgacggcgcctggggcggcatccagccgccctggatctacgggctgatggcgctctatgccgaaggctatccgctcaatcatcccgtgctcgcaaagggcctcgacgcgctgaacgatcccggctggcgcgtcgatgtcggtgacgccacctacatccaggccaccaacagcccggtctgggacacgatcctgaccttgctcgccttcgacgatgccggcgtgctcggcgactatcccgaggccgtcgacaaggcggtcgactgggtgctgcagcggcaggtgcgcgtgcccggcgactggtcgatgaagctgccgcatgtcaagcccggcggctgggcgttcgaatacgccaacaactactatcccgacacggacgacaccgcggtcgcgctgatcgcgctggcgccactgcgccacgatccgaaatggaaggccaaagggatcgacgaggctatccagctcggtgtcgactggctgatcggcatgcagagccagggcggcggctggggcgcgttcgacaaggacaacaaccagaagatcctgaccaagacnccgttctgcgattatggcgaggcgctcgatccgccctcggtcgacgtcaccgcccacatcatcgaggcgttcggcaagctcggcatctcgcgcaaccatccgtcgatggtgcaggcgctggactatattcgccgtgagcaggagccgagcggtccgtggttcggccgctggggcgtcaattacgtctacggcaccggcgcggtgctgccggcgctggccgcgatcggcgaggacatgacccagccctatatcggccgcgcctgcgactggctggttgcccatcagcaggccgatggcggctggggcgagagctgcgcctcctacatggatgtcagcgcggtcggccgcggcaccacaacggcctcgcagaccgcctgggcgctgatggcgctgctcgccgccaatcgcccccaggacaaggacgcgatcgagcgtggctgcatgtggctggtcgagcgccagtcggccggcacctgggacgagccggaattcaccggcaccggtttcccgggctacggcgtcggccagaccatcaagctgaacgatcccgcgctgtcgcagcggctgatgcagggcccggaattgtcccgcgccttcatgctccgctacggcatgtaccgccactacttcccgctgatggcgctcggccgcgccctacgcccgcagagtcatagctag

SEQ ID NO: 145 - protein, 684 aa, Artificial sequence
  Synthetic BjapSHC1 Derivative
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVFTRRWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKTPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCMWLVERQSAGTWDEPEFTGTGYPGYGVGQTIKLNDPALSQRLMQGPELSRAFMLRYGMYRHYFPLMALGRALRPQSHS

SEQ ID NO: 146 - DNA, 2055 bp, Artificial sequence
  Synthetic BjapSHC1 Derivative
  misc_feature (430)..(432): ngn is agr or cgn
  misc_feature (1377)..(1377): n is a, c, g, or t
atgactgtgaccagctcggcctccgcgcgtgcgacgcgcgacccgggaaattatcagactgccctgcaatcgacggtgcgcgcggcggcggattggctgatcgccaaccagaagccggacggccattgggtcggccgcgccgagtccaatgcctgcatggaggcgcaatggtgcctcgcgctgtggttcatggggctcgaggaccatccgctgcgcaagcgcctgggccagtcgctgctcgacagccagcgcccggacggcgcctggcaggtctatttcggcgcccccaatggcgacatcaacgcgactgtcgaggcctatgccgcgctccgctcgctgggcttccgcgacgacgagccggcggtgcgccgggcgcgggaatggatcgaggccaagggcggcctgcgcaacatccgcgtcttcacccgcngntggctggcactgatcggcgaatggccgtgggagaagacaccgaacatcccgccggaggtgatctggtttccgctctggtttccgttctcgatctacaatttcgcgcaatgggcccgcgccaccttgatgccgatcgccgtgctgtcggcgcggcggccgagccggccgctgccgccggagaaccgcctcgatgcgctgtttccgcatggacggaaggcgttcgactacgaactgccggtcaaggccggcgccggcggctgggacaggttcttccgcggcgccgacaaggttctgcacaagctgcagaacctcggcaaccgtctcaatctcggcctgttccgcccggcggccaccagccgcgtgctggaatggatgatccgccatcaggatttcgacggcgcctggggcggcatccagccgccctggatctacgggctgatggcgctctatgccgaaggctatccgctcaatcatcccgtgctcgcaaagggcctcgacgcgctgaacgatcccggctggcgcgtcgatgtcggtgacgccacctacatccaggccaccaacagcccggtctgggacacgatcctgaccttgctcgccttcgacgatgccggcgtgctcggcgactatcccgaggccgtcgacaaggcggtcgactgggtgctgcagcggcaggtgcgcgtgcccggcgactggtcgatgaagctgccgcatgtcaagcccggcggctgggcgttcgaatacgccaacaactactatcccgacacggacgacaccgcggtcgcgctgatcgcgctggcgccactgcgccacgatccgaaatggaaggccaaagggatcgacgaggctatccagctcggtgtcgactggctgatcggcatgcagagccagggcggcggctggggcgcgttcgacaaggacaacaaccagaagatcctgaccaagacnccgttctgcgattatggcgaggcgctcgatccgccctcggtcgacgtcaccgcccacatcatcgaggcgttcggcaagctcggcatctcgcgcaaccatccgtcgatggtgcaggcgctggactatattcgccgtgagcaggagccgagcggtccgtggttcggccgctggggcgtcaattacgtctacggcaccggcgcggtgctgccggcgctggccgcgatcggcgaggacatgacccagccctatatcggccgcgcctgcgactggctggttgcccatcagcaggccgatggcggctggggcgagagctgcgcctcctacatggatgtcagcgcggtcggccgcggcaccacaacggcctcgcagaccgcctgggcgctgatggcgctgctcgccgccaatcgcccccaggacaaggacgcgatcgagcgtggctgcatgtggctggtcgagcgccagtcggccggcacctgggacgagccggaattcaccggcaccggttayccgggctacggcgtcggccagaccatcaagctgaacgatcccgcgctgtcgcagcggctgatgcagggcccggaattgtcccgcgccttcatgctccgctacggcatgtaccgccactacttcccgctgatggcgctcggccgcgccctacgcccgcagagtcatagctag

SEQ ID NO: 147 - protein, 684 aa, Artificial sequence
  Synthetic BjapSHC1 Derivative
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVLTRRWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKTPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCMWLVERQSAGTWDEPEFTGTGYPGYGVGQTIKLNDPALSQRLMQGPELSRAFMLRYGMYRHYFPLMALGRALRPQSHS

SEQ ID NO: 148 - DNA, 2055 bp, Artificial sequence
  Synthetic BjapSHC1 Derivative
  misc_feature (421)..(423): ntn is ttr or ctn
  misc_feature (430)..(432): ngn is agr or cgn
  misc_feature (1377)..(1377): n is a, c, g, or t
atgactgtgaccagctcggcctccgcgcgtgcgacgcgcgacccgggaaattatcagactgccctgcaatcgacggtgcgcgcggcggcggattggctgatcgccaaccagaagccggacggccattgggtcggccgcgccgagtccaatgcctgcatggaggcgcaatggtgcctcgcgctgtggttcatggggctcgaggaccatccgctgcgcaagcgcctgggccagtcgctgctcgacagccagcgcccggacggcgcctggcaggtctatttcggcgcccccaatggcgacatcaacgcgactgtcgaggcctatgccgcgctccgctcgctgggcttccgcgacgacgagccggcggtgcgccgggcgcgggaatggatcgaggccaagggcggcctgcgcaacatccgcgtcntnacccgcngntggctggcactgatcggcgaatggccgtgggagaagacaccgaacatcccgccggaggtgatctggtttccgctctggtttccgttctcgatctacaatttcgcgcaatgggcccgcgccaccttgatgccgatcgccgtgctgtcggcgcggcggccgagccggccgctgccgccggagaaccgcctcgatgcgctgtttccgcatggacggaaggcgttcgactacgaactgccggtcaaggccggcgccggcggctgggacaggttcttccgcggcgccgacaaggttctgcacaagctgcagaacctcggcaaccgtctcaatctcggcctgttccgcccggcggccaccagccgcgtgctggaatggatgatccgccatcaggatttcgacggcgcctggggcggcatccagccgccctggatctacgggctgatggcgctctatgccgaaggctatccgctcaatcatcccgtgctcgcaaagggcctcgacgcgctgaacgatcccggctggcgcgtcgatgtcggtgacgccacctacatccaggccaccaacagcccggtctgggacacgatcctgaccttgctcgccttcgacgatgccggcgtgctcggcgactatcccgaggccgtcgacaaggcggtcgactgggtgctgcagcggcaggtgcgcgtgcccggcgactggtcgatgaagctgccgcatgtcaagcccggcggctgggcgttcgaatacgccaacaactactatcccgacacggacgacaccgcggtcgcgctgatcgcgctggcgccactgcgccacgatccgaaatggaaggccaaagggatcgacgaggctatccagctcggtgtcgactggctgatcggcatgcagagccagggcggcggctggggcgcgttcgacaaggacaacaaccagaagatcctgaccaagacnccgttctgcgattatggcgaggcgctcgatccgccctcggtcgacgtcaccgcccacatcatcgaggcgttcggcaagctcggcatctcgcgcaaccatccgtcgatggtgcaggcgctggactatattcgccgtgagcaggagccgagcggtccgtggttcggccgctggggcgtcaattacgtctacggcaccggcgcggtgctgccggcgctggccgcgatcggcgaggacatgacccagccctatatcggccgcgcctgcgactggctggttgcccatcagcaggccgatggcggctggggcgagagctgcgcctcctacatggatgtcagcgcggtcggccgcggcaccacaacggcctcgcagaccgcctgggcgctgatggcgctgctcgccgccaatcgcccccaggacaaggacgcgatcgagcgtggctgcatgtggctggtcgagcgccagtcggccggcacctgggacgagccggaattcaccggcaccggttayccgggctacggcgtcggccagaccatcaagctgaacgatcccgcgctgtcgcagcggctgatgcagggcccggaattgtcccgcgccttcatgctccgctacggcatgtaccgccactacttcccgctgatggcgctcggccgcgccctacgcccgcagagtcatagctag

SEQ ID NO: 149 - protein, 657 aa, Burkholderia ambifaria
MNDLTEMATLSAGTVPAGLDAAVASATDALLAAQNADGHWVYELEADSTIPAEYVLLVHYLGETPNLELEQKIGRYLRRVQQADGGWPLFTDGAPNISASVKAYFALKVIGDDENAEHMQRARRAIQAMGGAEMSNVFTRIQLALYGAIPWRAVPMMPVEIMLLPQWFPFHLSKVSYWARTVIVPLLVLNAKRPIAKNPRGVRIDELFVDPPVNAGLLPRQGHQSPGWFAFFRVVDHALRAADGLFPNYTRERAIRQAVSFVDERLNGEDGLGAIYPAMANAVMMYDVLGYAEDHPNRAIARKSIEKLLVVQEDEAYCQPCLSPVWDTSLAAHALLETGDARAEEAVIRGLEWLRPLQILDVRGDWISRRPHVRPGGWAFQYANPHYPDVDDTAVVAVAMDRVQKLKHNDAFRDSIARAREWVVGMQSSDGGWGAFEPENTQYYLNNIPFSDHGALLDPPTADVSGRCLSMLAQLGETPLNSEPARRALDYMLKEQEPDGSWYGRWGMNYVYGTWTALCALNAAGLTPDDPRVKRGAQWLLSIQNKDGGWGEDGDSYKLNYRGFEQAPSTASQTAWALLGLMAAGEVNNPAVARGVEYLIAEQKEHGLWDETRFTATGFPRVFYLRYHGYRKFFPLWALARYRNLKRNNATRVTFGL

SEQ ID NO: 150 - skipped

SEQ ID NO: 151 - protein, 682 aa, Burkholderia ambifaria
MIRRMNKSGPSPWSALDAAIARGRDALMRLQQPDGSWCFELESDATITAEYILMMHFMDKIDDARQEKMARYLRAIQRLDTHGGWDLYVDGDPDVSCSVKAYFALKAAGDSEHAPHMVRARDAILELGGAARSNVFTRILLATFGQVPWRATPFMPIEFVLFPKWVPISMYKVAYWARTTMVPLLVLCSLKARARNPRNIAIPELFVTPPDQERQYFPPARGMRRAFLALDRVVRHVEPLLPKRLRQRAIRHAQAWCAERMNGEDGLGGIFPPIVYSYQMMDVLGYPDDHPLRRDCENALEKLLVTRPDGSMYCQPCLSPVWDTAWSTMALEQARGVAVPEAGAPASALDELDARIARAYDWLAERQVNDLRGDWIENAPADTQPGGWAFQYANPYYPDIDDSAVVTAMLDRRGRTHRNADGSHPYAARVARALDWMRGLQSRNGGFAAFDADCDRLYLNAIPFADHGALLDPPTEDVSGRVLLCFGVTKRADDRASLARAIDYVKRTQQPDGSWWGRWGTNYLYGTWSVLAGLALAGEDPSQPYIARALAWLRARQHADGGWGETNDSYIDPALAGTNAGESTSNCTAWALLAQMAFGDGESESVRRGIAYLQSVQQDDGFWWHRSHNAPGFPRIFYLKYHGYTAYFPLWALARYRRLAGGVSAAGAHAVPASTGADAALA

SEQ ID NO: 152 - skipped

SEQ ID NO: 153 - protein, 617 aa, Bacillus anthracis
MLLYEKAHEEIVRRATALQTMQWQDGTWRFCFEGAPLTDCHMIFLLKLLGRDKEIEPFVERVASLQTNEGTWKLHEDEVGGNLSATIQSYAALLASKKYTKEDANMKRAENFIQERGGVARAHFMTKFLLAIHGEYEYPSLFHLPTPIMFLQNDSPFSIFELSSSARIHLIPMMLCLNKRFRVGKKLLPNLNHIAGGGGEWFREDRSPVFQTLLSDVKQIISYPLSLHHKGYEEIERFMKERIDENGTLYSYATASFYMIYALLALGHSLQSSMIQKAIAGITSYIWKMERGNHLQNSPSTVWDTALLSYALQEAQVSKDNKMIQNATAYLLKKQHTKKADWSVHAPALTPGGWGFSDVNTTIPDIDDTTAVLRALARSRGNKNIDNAWKKGGNWIKGLQNNDGGWGAFEKGVTSKLLAKLPIENASDMITDPSTPDITGRVLEFFGTYAQNELPEKQIQRAINWLMNVQEENGSWYGKWGICYLYGTWAVMTGLRSLGIPSSNPSLTRAASWLEHIQHEDGGWGESCHSSVEKRFVTLPFSTPSQTAWALDALISYYDTETPAIRKGVSYLLSNPYVNERYPTGTGLPGAFYIRYHSYAHIYPLLTLAHYIKKYRK

SEQ ID NO: 154 - DNA, 1854 bp, Bacillus anthracis
atgttattatacgaaaaagcgcatgaagaaatagtgagaagagcaacagcacttcaaacaatgcaatggcaagatggtacgtggcgattttgttttgaaggagctccattaacagattgccatatgatttttttattaaaattattaggtagagataaagagatagaaccgttcgtagaaagagtagcatcactccaaacaaatgaaggaacatggaaattgcacgaagatgaagtaggaggtaatttatcagctacaattcaatcttatgccgccttacttgcatcgaaaaaatatacaaaagaagatgcgaatatgaaacgagcagaaaattttattcaggaacgcggtggtgtggcgcgtgctcattttatgacgaagtttttattagcaattcatggagaatatgaatatccttcactctttcatttaccaacaccaatcatgtttttacagaatgattccccctttagtatatttgaattaagtagctcagcacgtattcatttaattccgatgatgctatgtttaaataaaagatttcgagtagggaaaaagttattaccaaatttaaatcacattgcgggcggaggcggagaatggtttcgggaggatcggtctccagtttttcaaacgttattaagtgatgtaaaacaaattatatcgtatccactttcgttacatcataaaggatatgaggaaatagaacgttttatgaaagagcgtattgatgaaaatggaacgttatatagttacgcaactgcctcgttttatatgatttatgctttacttgcgttagggcattctcttcaatcatcaatgattcaaaaggctatagctgggataacatcttatatatggaagatggaaagagggaatcatttgcaaaactctccttcaaccgtgtgggatacagctttattaagctatgcgttacaagaggctcaagtttcaaaggataataagatgattcaaaatgcaacagcgtatttattaaaaaaacagcatacaaaaaaagctgattggagcgtacatgctccggcgcttactcctggcggttggggtttttcggatgtgaatacgacaattccagatatagatgatacaacagctgtgctaagggcattggcacgaagtagaggaaacaaaaatatagataatgcttggaagaaagggggcaattggattaaaggattacaaaataatgatggtggctggggagcatttgaaaaaggtgtgacgagcaaattattagcaaaattaccaatcgaaaacgcaagtgatatgattacagatccttctacgccagatattacggggagagtgttagagtttttcgggacgtatgcacaaaacgaattgcctgagaaacagatacaaagggcaataaattggttaatgaatgtacaagaggaaaatggatcatggtatgggaaatgggggatttgttatctatatggtacgtgggctgttatgactggtttacggtcactcggaattccgtctagcaatccttcattgacacgagcagcttcatggcttgaacatatacagcatgaagatggtggttggggagaatcatgccacagtagtgtggagaaaaggttcgttactttaccatttagtacaccatcccaaactgcatgggcgttagatgctctcatttcttactatgatacagaaacgccagctattcgaaaaggtgtttcatatttgctttcgaatccttatgtgaatgaaagatatcctactggaacaggtttaccaggtgcgttttatattaggtatcatagctatgcccatatatatccactacttactttggcacattatataaaaaaatatagaaaataa

SEQ ID NO: 155 - protein, 720 aa, Frankia alni
MPAGVGVLVWLDQRLRAMGRPDLVTTTGGAEIPFVLVAATASTVGVALALRRPRHPVGWLFLALGGVLLLSGGTQGYAAYGAVARPGRLPAADLVAIYADAGFIPWLVLVALILHLTPTGRPLSARWGRIALATAVAGGLWLLVGLVTTETMQPPFQSVTNPLLIGGPLGPLLVARRVLGLATGAGVVLAAVSLIVRFRRSVDVERRQLLWVAVAAVPLPVLMAASFAASYAGNNTAAGLAAATLIGLLAIGAGLAIGQYHLYDVEEILSRAVTYLLVSGLLAASYATVVIVVGQSLAGRTGRSQISAVLATLAAVAVTAPAYRKIQEGVDRRFSRRRFETLQVIRRYLRDPDPDVAVEEVLRRALGDPTLAVAYLVDDRRQWVSADGQPANPGNSFMAAVEVYRRGRPIARVTFDRGRAQPGLVRAAATAATAELDNAGLRAAVALQLVEVRQSRTRIAAAQFAERRTIERNLHDGAQQRLLALALQLRAVQLGGDEASLRQAISTGIDQLQAAVVELRELANGLHPAVLADGGLAAALDDVAARTPVPIKISAPDRRYPPDLEAAAWFIACEAMANAVKHAHPTTIAVDVSAPDGQLIVEVRDDGIGGAQPSGPGLRGIADRAEAFGGSLTVHTDPGTGTTIRALLHRRSPLSSGRRSVMIEGCVDVVAVRRFRCRSSRGSGSRRRRSSWRCGGICGSRCRTGMSRSCSRNAASKLIT

SEQ ID NO: 156 - skipped

SEQ ID NO: 157 - protein, 685 aa, Rhodopseudomonas palent
MDSILAPRADAPRNIDGALRESVQQAADWLVANQKPDGHWVGRAETNATMEAQWCLALWFLGLEDHPLRVRLGRALLDTQRPDGAWHVFYGAPNGDINATVEAYAALRSLGHRDDEEPLRKARDWILSKGGLANIRVFTRYWLALIGEWPWEKTPNILPEVIWLPTWFPFSIYNFAQWARATLMPIAVLSAHRPSRPLAPQDRLDALFPQGRDSFNYDLPARLGAGVWDVIFRKIDTILHRLQDWGARRGPHGIMRRGAIDHVLQWIIRHQDYDGSWGGIQPPWIYGLMALHTEGYAMTHPVMAKALDALNEPGWRIDIGDATFIQATNSPVWDTMLSLLAFDDAGLGERYPEQVERAVRWVLKRQVLVPGDWSVKLPDVKPGGWAFEYANNFYPDTDDTSVALMALAPFRHDPKWQAEGIEDAIQRGIDWLVAMQCKEGGWGAFDKDNDKKILAKIPFCDFGEALDPPSADVTAHIIEAFAKVGLDRNHPSIVRALDYLKREQEPEGPWFGRWGVNYVYGTGAVLPALAAIGEDMRQPYIARACDWLIARQQANGGWGESCVSYMDAKQAGEGTATASQTAWALMALIAADRPQDRDAIERGCLYLTETQRDGTWQEVHYTGTGFPGYGVGQTIKLNDPLLSKRLMQGPELSRSFMLRYDLYRHYFPMMAIGRVLRQRGDRSGH

SEQ ID NO: 158 - skipped

SEQ ID NO: 159 - protein, 679 aa, Streptomyces coelicolor
MTATTDGSTGASLRPLAASASDTDITIPAAAAGVPEAAARATRRATDFLLAKQDAEGWWKGDLETNVTMDAEDLLLRQFLGIQDEETTRAAALFIRGEQREDGTWATFYGGPGELSTTIEAYVALRLAGDSPEAPHMARAAEWIRSRGGIASARVFTRIWLALFGWWKWDDLPELPPELIYFPTWVPLNIYDFGCWARQTIVPLTIVSAKRPVRPAPFPLDELHTDPARPNPPRPLAPVASWDGAFQRIDKALHAYRKVAPRRLRRAAMNSAARWIIERQENDGCWGGIQPPAVYSVIALYLLGYDLEHPVMRAGLESLDRFAVWREDGARMIEACQSPVWDTCLATIALADAGVPEDHPQLVKASDWMLGEQIVRPGDWSVKRPGPPGGWAFEFHNDNYPDIDDTAEVVLALRRVRHHDPERVEKAIGRGVRWNLGMQSKNGAWGAFDVDNTSAFPNRLPFCDFGEVIDPPSADVTAHVVEMLAVEGLAHDPRTRRGIQWLLDAQETDGSWFGRWGVNYVYGTGSVIPALTAAGLPTSHPAIRRAVRWLESVQNEDGGWGEDLRSYRYVREWSGRGASTASQTGWALMALLAAGERDSKAVERGVAWLAATQREDGSWDEPYFTGTGFPWDFSINYNLYRQVFPLTALGRYVHGEPFAKKPRAADAPAEAAPAEVKGS

SEQ ID NO: 160 - skipped

SEQ ID NO: 161 - protein, 725 aa, Zymomonas mobilis; identical to SEQ ID NO: 2

SEQ ID NO: 162 - DNA, 2178 bp, Zymomonas mobilis; identical to SEQ ID NO: 44

SEQ ID NO: 163 - protein, 725 aa, Zymomonas mobilis; identical to SEQ ID NO: 2

SEQ ID NO: 164 - DNA, 2178 bp, Zymomonas mobilis; identical to SEQ ID NO: 44

SEQ ID NO: 165 - DNA, 1896 bp, Alicyclobacillus acidocaldarius
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgttcacgcggatgtggctggcgctggtgggagaatatccatgggagaaggtgcccatggtcccgccggagatcatgttcctcggcaagcgtatgccgctcaacatttacgagtttggctcgtgggcccgggcgaccgtcgtggcgatctcaattgtcatgagccgccagccggtgttcccgctgcccgagcgggcgcgcgtgcccgagctgtacgataccgacgtgcctccgcgccggcgcggcgccaagggaggcggcgggcgaatcttcgacgcgctggatcgcgccctgcacgggtatcagaagctgtcggtgcacccgttccgccgcgcggccgagatccgggccttggactggctgctcgagcgccaggccggagacggcagttggggcgggattcagccgccctggttttatacgctcatcgcgctcaagattctcgacatgacgcagcatccggcgttcatcaagggttgggagggcctcgagctgtacggagtggacctcgactacggcggatggatgtttcaggcttccatctcgccggtgtgggacacgggtcttgccgtgctcgcgctgcgcgccgcggggcttccggccgatcacgaccggttggtcaaggcgggcgagtggcttttggaccggcagatcaccgtgccgggagactgggcggtgaagcgcccgaacctcaaaccgggcgggttcgcgttccagttcgacaacgtgtattacccggacgtcgacgacacggccgtcgtggtctgggcgctgaacagccttcgcttgccggacgagcgccgcaggcgggacgtgatgacgaaggggttccgctggatcgtcggtatgcagagttccaacggcggctggggcgcgtacgacgtcgacaacacgagcgatctgccaaaccacatcccgttctgcgacttcggcgaagtgaccgatccgccgtcggaggacgtcaccgcccacgtgctcgagtgtttcggcagcttcggctacgacgacgcctggaaggtgatccggcgcgcggtcgagtacctcaagcgcgaacagcgcccggatggcagttggtttggccgctggggcgtcaactacctgtacggcacgggagcggtcgtgcccgcgctgaaggccgtcgggatcgacgtgcgcgagccgttcattcagaaggcgctcgattgggtcgagcagcatcagaacccggacggtggctggggcgaggactgccgctcgtacgaggatccggcgtacgcgggcaagggcgcgagcaccccgtcgcagacggcttgggcgctgatggcactcatcgcgggcggcagggcggagtcggattccgtgcgccgcggcgtgcaatatctcgtggagacgcagcgcccggacggcggctgggatgagccgtactacaccggcacgggcttcccgggcgatttctacctcggctacaccatgtaccgccacgtgtttccgacgctcgcgctcggccgctacaagcaagccatcgagcgcaggtga

SEQ ID NO: 166 - DNA, 2178 bp, Zymomonas mobilis; identical to SEQ ID NO: 44

SEQ ID NO: 167 - DNA, 1977 bp, Zymomonas mobilis; identical to SEQ ID NO: 80

SEQ ID NO: 168 - DNA, 2055 bp, Bradyrhizobium japonicum; identical to SEQ ID NO: 114

SEQ ID NO: 169 - DNA, 1896 bp, Alicyclobacillus acidocaldarius
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgttcacgcggatgtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacatcccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggcttcccaggggatttctacctcggctacaccatgtaccgccacgtgtttccgacgctcgcgctcggccgctacaagcaagccatcgagcgcaggtga

SEQ ID NO: 170 - DNA, 1896 bp, Artificial sequence
  Synthetic AacSHC Derivative
atggctgagcagttggtggaagcgccggcctacgcgcggacgctggatcgcgcggtggagtatctcctctcctgccaaaaggacgaaggctactggtgggggccgcttctgagcaacgtcacgatggaagcggagtacgtcctcttgtgccacattctcgatcgcgtcgatcgggatcgcatggagaagatccggcggtacctgttgcacgagcagcgcgaggacggcacgtgggccctgtacccgggtgggccgccggacctcgacacgaccatcgaggcgtacgtcgcgctcaagtatatcggcatgtcgcgcgacgaggagccgatgcagaaggcgctccggttcattcagagccagggcgggatcgagtcgtcgcgcgtgttcacgcggatgtggctggcgctggtgggagaatatccgtgggagaaggtgcccatggtcccgccggagatcatgttcctcggcaagcgcatgccgctcaacatctacgagtttggctcgtgggctcgggcgaccgtcgtggcgctctcgattgtgatgagccgccagccggtgttcccgctgcccgagcgggcgcgcgtgcccgagctgtacgagaccgacgtgcctccgcgccggcgcggtgccaagggagggggtgggtggatcttcgacgcgctcgaccgggcgctgcacgggtatcagaagctgtcggtgcacccgttccgccgcgcggccgagatccgcgccttggactggttgctcgagcgccaggccggagacggcagctggggcgggattcagccgccttggttttacgcgctcatcgcgctcaagattctcgacatgacgcagcatccggcgttcatcaagggctgggaaggtctagagctgtacggcgtggagctggattacggaggatggatgtttcaggcttccatctcgccggtgtgggacacgggcctcgccgtgctcgcgctgcgcgctgcggggcttccggccgatcacgaccgcttggtcaaggcgggcgagtggctgttggaccggcagatcacggttccgggcgactgggcggtgaagcgcccgaacctcaagccgggcgggttcgcgttccagttcgacaacgtgtactacccggacgtggacgacacggccgtcgtggtgtgggcgctcaacaccctgcgcttgccggacgagcgccgcaggcgggacgccatgacgaagggattccgctggattgtcggcatgcagagctcgaacggcggttggggcgcctacgacgtcgacaacacgagcgatctcccgaaccacatcccgttctgcgacttcggcgaagtgaccgatccgccgtcagaggacgtcaccgcccacgtgctcgagtgtttcggcagcttcgggtacgatgacgcctggaaggtcatccggcgcgcggtggaatatctcaagcgggagcagaagccggacggcagctggttcggtcgttggggcgtcaattacctctacggcacgggcgcggtggtgtcggcgctgaaggcggtcgggatcgacacgcgcgagccgtacattcaaaaggcgctcgactgggtcgagcagcatcagaacccggacggcggctggggcgaggactgccgctcgtacgaggatccggcgtacgcgggtaagggcgcgagcaccccgtcgcagacggcctgggcgctgatggcgctcatcgcgggcggcagggcggagtccgaggccgcgcgccgcggcgtgcaatacctcgtggagacgcagcgcccggacggcggctgggatgagccgtactacaccggcacgggcttcccaggggattggtacctcggctacaccatgtaccgccacgtgtttccgacgctcgcgctcggccgctacaagcaagccatcgagcgcaggtga

SEQ ID NO: 171 - protein, 631 aa, Artificial sequence
  Synthetic AacSHC Derivative
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRMWLALVGEYPWEKVPMVPPEIMFLGKRMPLNIYEFGSWARATVVALSIVMSRQPVFPLPERARVPELYETDVPPRRRGAKGGGGWIFDALDRALHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHIPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVQYLVETQRPDGGWDEPYYTGTGFPGDWYLGYTMYRHVFPTLALGRYKQAIERR

SEQ ID NO: 172 - DNA, 2178 bp, Artificial sequence
  Synthetic ZmoSHC1 Derivative
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtctttacccgttattggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaattcctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggattccccggttatggcgtgggtcagacgatcaagttggatgatccggctttatcgaaacgattgcttcaaggcgctgaactgtcacgggcgtggatgctgcgttatgatttttatcggcaattcttcccgattatggcgttaagtcgggcagagagactgattgatttgaataattga

SEQ ID NO: 173 - protein, 725 aa, Artificial sequence
  Synthetic ZmoSHC1 Derivative
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVFTRYWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKIPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGFPGYGVGQTIKLDDPALSKRLLQGAELSRAWMLRYDFYRQFFPIMALSRAERLIDLNN

SEQ ID NO: 174 - DNA, 1977 bp, Artificial sequence
  Synthetic ZmoSHC2 Derivative
atgactgtatcgacttcctcggcttttcatcatagcccgttgtctgatgatgttgagccgattatccaaaaggccacccgtgccttgcttgagaagcagcagcaggatggccattgggtttttgaattggaagccgatgcaaccattcccgctgaatacatcctgttaaagcattatttgggtgaacccgaagatttagaaatagaggccaagataggtcgctatttgcgtcgtattcagggcgagcatggcggatggtctttgttttatggtggtgatcttgatttgagcgccacggtcaaagcctattttgccttgaaaatgatcggagattctcctgatgcgcctcatatgcttcgagccagaaatgaaattttggcacggggtggggcgatgcgtgccaatgtctttacacgtattcaattagctctgttcggggcaatgtcatgggagcatgtccctcaaatgcccgtagagttgatgttgatgccggaatggtttccggttcacatcaataaaatggcctattgggcaagaaccgttttagtcccgttattggttttacaggcgttaaagcctgtcgcccgtaatcggcgcggtatcttggttgatgaattatttgtgccggatgttttaccgacccttcaggaaagcggtgaccctatatggcgtcgttttttttcggcacttgataaggtattgcataaagtagaaccttattggccgaaaaatatgcgcgcgaaggctattcatagctgtgtccattttgtgaccgagcgtttgaatggtgaagacgggttgggtgctatttatccggcgattgccaatagcgtcatgatgtatgatgccttgggatatcccgaaaaccatccagaaagagccattgcccgtcgggctgtcgaaaaattgatggtgttagatggcacggaagatcagggtgataaagaagtctactgtcagccttgtttatccccgatttgggataccgctttggttgcccatgccatgttggaagtcggaggcgatgaggctgaaaaatcggctatttctgccttgagctggttaaagccgcaacaaattttggatgtaaagggcgattgggcatggcggcggcctgatctcagacccgggggatgggcctttcaatatagaaatgactattatcccgatgtcgatgatacggctgttgtgactatggcgatggatcgagccgcaaaattgtcggatcttcacgatgattttgaggaatctaaagcgcgtgccatggaatggaccattgggatgcaaagcgataatggcggttggggcgctttcgatgccaataacagctatacttatctgaataatattccctttgctgatcatggcgcgttacttgatccgccaacggtcgatgtctcggcacgctgcgtttcaatgatggcgcaagccggtatctcgattacagatcccaaaatgaaagcggcagttgattatcttctgaaagagcaagaagaggatggtagctggttcgggcgttggggtgtcaattacatatatggcacatggtcggccttatgtgcattgaatgtggccgctttaccccatgatcatttagctgttcagaaagctgtggcttggctgaaaactattcaaaatgaagatggtggttggggtgaaaattgcgatagctatgcccttgattatagcggatacgagccgatggattcgacggcttcccaaacagcatgggctttattgggcttgatggctgttggggaagctaattccgaggccgtgacaaagggtataaactggttggcacaaaatcaggatgaagaaggattgtggaaagaagattattatagtggcggtggttttccccgtgtttggtatcttcggtatcacggttattccaaatattttcctctttgggctttagcgcgctatcgcaatttgaaaaaagccaatcagccgattgttcattatgggatgtaa

SEQ ID NO: 175 - protein, 658 aa, Artificial sequence
  Synthetic ZmoSHC2 Derivative
MTVSTSSAFHHSPLSDDVEPIIQKATRALLEKQQQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVFTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGINWLAQNQDEEGLWKEDYYSGGGFPRVWYLRYHGYSKYFPLWALARYRNLKKANQPIVHYGM

SEQ ID NO: 176 - DNA, 2055 bp, Artificial sequence
  Synthetic BjapSHC1 Derivative
atgactgtgaccagctcggcctccgcgcgtgcgacgcgcgacccgggaaattatcagactgccctgcaatcgacggtgcgcgcggcggcggattggctgatcgccaaccagaagccggacggccattgggtcggccgcgccgagtccaatgcctgcatggaggcgcaatggtgcctcgcgctgtggttcatggggctcgaggaccatccgctgcgcaagcgcctgggccagtcgctgctcgacagccagcgcccggacggcgcctggcaggtctatttcggcgcccccaatggcgacatcaacgcgactgtcgaggcctatgccgcgctccgctcgctgggcttccgcgacgacgagccggcggtgcgccgggcgcgggaatggatcgaggccaagggcggcctgcgcaacatccgcgtcttcacccgctactggctggcactgatcggcgaatggccgtgggagaagacaccgaacatcccgccggaggtgatctggtttccgctctggtttccgttctcgatctacaatttcgcgcaatgggcccgcgccaccttgatgccgatcgccgtgctgtcggcgcggcggccgagccggccgctgccgccggagaaccgcctcgatgcgctgtttccgcatggacggaaggcgttcgactacgaactgccggtcaaggccggcgccggcggctgggacaggttcttccgcggcgccgacaaggttctgcacaagctgcagaacctcggcaaccgtctcaatctcggcctgttccgcccggcggccaccagccgcgtgctggaatggatgatccgccatcaggatttcgacggcgcctggggcggcatccagccgccctggatctacgggctgatggcgctctatgccgaaggctatccgctcaatcatcccgtgctcgcaaagggcctcgacgcgctgaacgatcccggctggcgcgtcgatgtcggtgacgccacctacatccaggccaccaacagcccggtctgggacacgatcctgaccttgctcgccttcgacgatgccggcgtgctcggcgactatcccgaggccgtcgacaaggcggtcgactgggtgctgcagcggcaggtgcgcgtgcccggcgactggtcgatgaagctgccgcatgtcaagcccggcggctgggcgttcgaatacgccaacaactactatcccgacacggacgacaccgcggtcgcgctgatcgcgctggcgccactgcgccacgatccgaaatggaaggccaaagggatcgacgaggctatccagctcggtgtcgactggctgatcggcatgcagagccagggcggcggctggggcgcgttcgacaaggacaacaaccagaagatcctgaccaagatcccgttctgcgattatggcgaggcgctcgatccgccctcggtcgacgtcaccgcccacatcatcgaggcgttcggcaagctcggcatctcgcgcaaccatccgtcgatggtgcaggcgctggactatattcgccgtgagcaggagccgagcggtccgtggttcggccgctggggcgtcaattacgtctacggcaccggcgcggtgctgccggcgctggccgcgatcggcgaggacatgacccagccctatatcggccgcgcctgcgactggctggttgcccatcagcaggccgatggcggctggggcgagagctgcgcctcctacatggatgtcagcgcggtcggccgcggcaccacaacggcctcgcagaccgcctgggcgctgatggcgctgctcgccgccaatcgcccccaggacaaggacgcgatcgagcgtggctgcatgtggctggtcgagcgccagtcggccggcacctgggacgagccggaattcaccggcaccggtttcccgggctacggcgtcggccagaccatcaagctgaacgatcccgcgctgtcgcagcggctgatgcagggcccggaattgtcccgcgcctggatgctccgctacggcatgtaccgccactacttcccgctgatggcgctcggccgcgccctacgcccgcagagtcatagctag

SEQ ID NO: 177 - protein, 684 aa, Artificial sequence
  Synthetic BjapSHC1 Derivative
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVFTRYWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKIPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCMWLVERQSAGTWDEPEFTGTGFPGYGVGQTIKLNDPALSQRLMQGPELSRAWMLRYGMYRHYFPLMALGRALRPQSHS

SEQ ID NO: 178 - protein, 631 aa, Alicyclobacillus acidocaldarius
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRMWLALVGEYPWEKVPMVPPEIMFLGKRMPLNIYEFGSWARATVVAISIVMSRQPVFPLPERARVPELYDTDVPPRRRGAKGGGGRIFDALDRALHGYQKLSVHPFRRAAEIRALDWLLERQAGDGSWGGIQPPWFYTLIALKILDMTQHPAFIKGWEGLELYGVDLDYGGWMFQASISPVWDTGLAVLALRAAGLPADHDRLVKAGEWLLDRQITVPGDWAVKRPNLKPGGFAFQFDNVYYPDVDDTAVVVWALNSLRLPDERRRRDVMTKGFRWIVGMQSSNGGWGAYDVDNTSDLPNHIPFCDFGEVTDPPSEDVTAHVLECFGSFGYDDAWKVIRRAVEYLKREQRPDGSWFGRWGVNYLYGTGAVVPALKAVGIDVREPFIQKALDWVEQHQNPDGGWGEDCRSYEDPAYAGKGASTPSQTAWALMALIAGGRAESDSVRRGVQYLVETQRPDGGWDEPYYTGTGFPGDFYLGYTMYRHVFPTLALGRYKQAIERR

SEQ ID NO: 179 - DNA, 382 bp, Artificial sequence
  Synthetic plasmid pET-28a(+) cloning/expression region
  CDS (109)..(285)
agatctcgatcccgcgaaattaatacgactcactataggggaattgtgagcggataacaattcccctctagaaataatttttgtttaactttaagaaggagatataccatgggcagcagccatcatcatcatcatcacagcagcggcctggtgccgcgcggcagccatatggctagcatgactggtggacagcaaatgggtcgcggatccgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttg

SEQ ID NO: 180 - protein, 58 aa, Artificial sequence
  Synthetic Construct
MGSSHHHHHHSSGLVPRGSHMASMTGGQQMGRGSEFELRRQACGRTRAPPPPPLRSGC

SEQ ID NO: 181 - DNA, 94 bp, Artificial sequence
  Synthetic plasmid pET-28b(+) cloning/expression region
  CDS (1)..(72)
ggtcgggatccgaattcgagctccgtcgacaagcttgcggccgcactcgagcaccaccaccaccaccactgagatccggctgctaacaaagccc

SEQ ID NO: 182 - protein, 23 aa, Artificial sequence
  Synthetic Construct
GRDPNSSSVDKLAAALEHHHHHH

SEQ ID NO: 183 - DNA, 93 bp, Artificial sequence
  Synthetic plasmid pET-28c(+) cloning/expression region
  CDS (1)..(93)
ggtcggatccgaattcgagctccgtcgacaagcttgcggccgcactcgagcaccaccaccaccaccactgagatccggctgctaacaaagccc

SEQ ID NO: 184 - protein, 31 aa, Artificial sequence
  Synthetic Construct
GRIRIRAPSTSLRPHSSTTTTTTEIRLLTKP

SEQ ID NO: 185 - protein, 631 aa, Artificial sequence
  Synthetic SHC derivative
  VARIANT (77)..(77): T77X has X selected from: A, C, D, E, F, G, H, I, K, L, M, N, P, Q, R, S, T, V, W or Y
  VARIANT (92)..(92): I92X has X selected from: A, C, D, E, F, G, H, I, K, L, M, N, P, Q, R, S, T, V, W or Y
  VARIANT (129)..(129): F129X has X selected from: A, C, D, E, F, G, H, I, K, L, M, N, P, Q, R, S, T, V, W or Y.
  VARIANT (132)..(132): M132X has X selected from: A, C, D, E, F, G, H, I, K, L, M, N, P, Q, R, S, T, V, W or Y.
  VARIANT (224)..(224): A224X has X selected from: A, C, D, E, F, G, H, I, K, L, M, N, P, Q, R, S, T, V, W or Y.
  VARIANT (432)..(432): I432X has X selected from: A, C, D, E, F, G, H, I, K, L, M, N, P, Q, R, S, T, V, W or Y.
  VARIANT (579)..(579): Q579X has X selected from: A, C, D, E, F, G, H, I, K, L, M, N, P, Q, R, S, T, V, W or Y.
  VARIANT (601)..(601): F601X has X selected from: A, C, D, E, F, G, H, I, K, L, M, N, P, Q, R, S, T, V, W or Y.
MAEQLVEAPAYARTLDRAVEYLLSCQKDEGYWWGPLLSNVTMEAEYVLLCHILDRVDRDRMEKIRRYLLHEQREDGXWALYPGGPPDLDTTXEAYVALKYIGMSRDEEPMQKALRFIQSQGGIESSRVXTRXWLALVGEYPWEKVPMVPPEIMFLGKRMPLNIYEFGSWARATVVALSIVMSRQPVFPLPERARVPELYETDVPPRRRGAKGGGGWIFDALDRXLHGYQKLSVHPFRRAAEIRALDWLLERQAGDGSWGGIQPPWFYALIALKILDMTQHPAFIKGWEGLELYGVELDYGGWMFQASISPVWDTGLAVLALRAAGLPADHDRLVKAGEWLLDRQITVPGDWAVKRPNLKPGGFAFQFDNVYYPDVDDTAVVVWALNTLRLPDERRRRDAMTKGFRWIVGMQSSNGGWGAYDVDNTSDLPNHXPFCDFGEVTDPPSEDVTAHVLECFGSFGYDDAWKVIRRAVEYLKREQKPDGSWFGRWGVNYLYGTGAVVSALKAVGIDTREPYIQKALDWVEQHQNPDGGWGEDCRSYEDPAYAGKGASTPSQTAWALMALIAGGRAESEAARRGVXYLVETQRPDGGWDEPYYTGTGXPGDFYLGYTMYRHVFPTLALGRYKQAIERR

SEQ ID NO: 186 - protein, 725 aa, Artificial sequence
  Synthetic SHC derivative
  VARIANT (129)..(129): S129X has X selected from: A, C, D, E, F, G, H, I, K, L, M, N, P, Q, R, S, T, V, W or Y.
  VARIANT (145)..(145): V145X has X selected from: A, C, D, E, F, G, H, I, K, L, M, N, P, Q, R, S, T, V, W or Y.
  VARIANT (182)..(182): F182X has X selected from: A, C, D, E, F, G, H, I, K, L, M, N, P, Q, R, S, T, V, W or Y.
  VARIANT (185)..(185): Y185X has X selected from: A, C, D, E, F, G, H, I, K, L, M, N, P, Q, R, S, T, V, W or Y.
  VARIANT (282)..(282): G282X has X selected from: A, C, D, E, F, G, H, I, K, L, M, N, P, Q, R, S, T, V, W or Y.
  VARIANT (498)..(498): I498X has X selected from: A, B, C, D, E, F, G, H, I, K, L, M, N, P, Q, R, S, T, V, W or Y.
  VARIANT (646)..(646): H646X has X selected from: A, C, D, E, F, G, H, I, K, L, M, N, P, Q, R, S, T, V, W or Y.
  VARIANT (668)..(668): F668X has X selected from: A, C, D, E, F, G, H, I, K, L, M, N, P, Q, R, S, T, V, W or Y.
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGXWGVYFGAGNGDINATXEAYAALRSLGYSADNPVLKKAAAWIAEKGGLKNIRVXTRXWLALIGEWPWEKTPNLPPEIIWFPDNFVFSIYNFAQWARATMVPIAILSARRPSRPLRPQDRLDELFPEGRARFDYELPKKEGIDLWSQFFRTTDRXLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKXPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCXYLIDRQEQDGSWKEEEFTGTGXPGYGVGQTIKLDDPALSKRLLQGAELSRAFMLRYDFYRQFFPIMALSRAERLIDLNN

SEQ ID NO: 187 - protein, 658 aa, Artificial sequence
  Synthetic SHC derivative
  VARIANT (85)..(85): G85X has X selected from: A, C, D, E, F, G, H, I, K , L, M, N, P, Q, R, S, T, V, W or Y.
  VARIANT (100)..(100): V100X has X selected from: A, C, D, E, F, G, H, I, K, L, M, N, P, Q, R, S, T, V, W or Y.
  VARIANT (137)..(137): F137X has X selected from: A, C, D, E, F, G, H, I, K, L, M, N, P, Q, R, S, T, V, W or Y.
  VARIANT (140)..(140): I140X has X selected from: A,, C, D, E, F, G, H, I, K, L, M, N, P, Q, R, S, T, V, W or Y.
  VARIANT (233)..(233): V233X has X selected from: A, C, D, E, F, G, H, I, K, L, M, N, P, Q, R, S, T, V, W or Y.
  VARIANT (450)..(450): I450X has X selected from: A, C, D, E, F, G, H, I, K, L, M, N, P, Q, R, S, T, V, W or Y.
  VARIANT (598)..(598): N598X has X selected from: A, C, D, E, F, G, H, I, K, L, M, N, P, Q, R, S, T, V, W or Y
  VARIANT (620)..(620): F620X has X selected from: A, C, D, E, F, G, H, I, K, L, M, N, P, Q, R, S, T, V, W or Y.
MTVSTSSAFHHSPLSDDVEPIIQKATRALLEKQQQDGHWVFELEADATIPAEYILLKHYLGEPEDLEIEAKIGRYLRRIQGEHGXWSLFYGGDLDLSATXKAYFALKMIGDSPDAPHMLRARNEILARGGAMRANVXTRXQLALFGAMSWEHVPQMPVELMLMPEWFPVHINKMAYWARTVLVPLLVLQALKPVARNRRGILVDELFVPDVLPTLQESGDPIWRRFFSALDKXLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNXPFADHGALLDPPTVDVSARCVSMMAQAGISITDPKMKAAVDYLLKEQEEDGSWFGRWGVNYIYGTWSALCALNVAALPHDHLAVQKAVAWLKTIQNEDGGWGENCDSYALDYSGYEPMDSTASQTAWALLGLMAVGEANSEAVTKGIXWLAQNQDEEGLWKEDYYSGGGXPRVFYLRYHGYSKYFPLWALARYRNLKKANQPIVHYGM

SEQ ID NO: 188 - protein, 684 aa, Artificial sequence
  Synthetic SHC derivative
  VARIANT (88)..(88): A88X has X selected from: A, C, D, E, F, G, H, I, K, L, M, N, P, Q, R, S, T, V, W or Y.
  VARIANT (104)..(104): V104X has X selected from: A, C, D, E, F, G, H, I, K, L, M, N, P, Q, R, S, T, V, W or Y.
  VARIANT (141)..(141): F141X, has X selected from: A, C, D, E, F, G, H, I, K, L, M, N, P, Q, R, S, T, V, W or Y.
  VARIANT (144)..(144): Y144X has X selected from: A, C, D, E, F, G, H, I, K, L, M, N, P, Q, R, S, T, V, W or Y.
  VARIANT (241)..(241): V241X has X selected from: A, C, D, E, F, G, H, I, K, L, M, N, P, Q, R, S, T, V, W or Y.
  VARIANT (459)..(459): I459X has X selected from: A, C, D, E, F, G, H, I, K, L, M, N, P, Q, R, S, T, V, W or Y.
  VARIANT (607)..(607): M607X has X selected from: A, C, D, E, F, G, H, I, K, L, M, N, P, Q, R, S, T, V, W or Y.
  VARIANT (628)..(628): F628X has X selected from: A, C, D, E, F, G, H, I, K, L, M, N, P, Q, R, S, T, V, W or Y.
MTVTSSASARATRDPGNYQTALQSTVRAAADWLIANQKPDGHWVGRAESNACMEAQWCLALWFMGLEDHPLRKRLGQSLLDSQRPDGXWQVYFGAPNGDINATXEAYAALRSLGFRDDEPAVRRAREWIEAKGGLRNIRVXTRXWLALIGEWPWEKTPNIPPEVIWFPLWFPFSIYNFAQWARATLMPIAVLSARRPSRPLPPENRLDALFPHGRKAFDYELPVKAGAGGWDRFFRGADKXLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKXPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCXWLVERQSAGTWDEPEFTGTGXPGYGVGQTIKLNDPALSQRLMQGPELSRAFMLRYGMYRHYFPLMALGRALRPQSHS

The invention claimed is:

1. A process for preparing (−)-Ambrox or a mixture comprising (−)-Ambrox, wherein a mixture of isomers comprising (3E,7E)-homofarnesol (EEH) is enzymatically converted to (−)-Ambrox or a mixture comprising (−)-Ambrox wherein the enzymatic conversion is carried out using an squalene hopene cyclase/homofarnesol Ambrox cyclase (SHC/HAC) enzyme having the polypeptide sequence SEQ ID No. 21 under reaction conditions suitable for the production of (−)-Ambrox, and wherein the mixture of isomers comprises homofarnesol isomers selected from one or more of the following groups consisting of [(3E,7E) and [(3Z,7E)] and/or [(3E,7E) and (3E,7Z)] and/or [(3Z,7E), (3E,7E) and (3E,7Z)] also designated as [EE:EZ], [EE:ZE] and [EE:EZ: ZE] respectively.

2. The process according to claim 1, wherein the process uses a recombinant host cell biocatalyst producing the SHC/HAC enzyme.

3. The process according to claim 1, wherein the conversion of homofarnesol to (−)-Ambrox takes place at a temperature in the range of from 30° C. to 60° C., at a pH in the range of about 4-8.

4. The process according to claim 3, wherein the conversion of homofarnesol to (−)-Ambrox takes place at a temperature of about 34° C. to about 50° C., at a pH in the range of about 5-6.2.

5. The process according to claim 2 further comprising sodium dodecyl sulfate (SDS), wherein the SDS/cell ratio is in the range of 10:1 to 20:1.

6. The process according to claim 2, wherein the weight ratio of biocatalyst to homofarnesol is in the range of from about 0.5-2:1.

7. The process according to claim 1, wherein the homofarnesol substrate comprises two homofarnesol isomers.

8. The process according to claim 7, wherein the homofarnesol substrate comprises EE:EZ isomers.

9. The process according to claim 1, wherein the homofarnesol comprises an EE:EZ isomer mixture in the weight ratios selected from the group consisting of: 100:00; 99:01; 98:02; 97:03; 96:04; 95:05; 94:06; 93:07; 92:08; 91:09; 90:10; 89:11; 88:12; 87:13; 86:14; 85:15; 84:16; 83:17; 82:18; 81:19; 80:20; 79:21; 78:22; 77:23; 76:24; 75:25; 74:26; 73:27; 72:28; 71:29 70:30; 69:31; 68:32; 67:33; 66:34; 65:35; 64:36; 63:37; 62:38; 61:39; and/or 60:40.

10. The process according to claim 1, wherein the homofarnesol comprises an EE:EZ isomer mixture in a weight ratio selected from the group consisting of: EE:EZ 92:08; EE:EZ 90:10; EE:EZ 80:20; EE:EZ 86:14; EE:EZ 70:30; EE:EZ 69:31; and/or EE:EZ 66:34.

11. The process according to claim 10 wherein the homofarnesol comprises EE:EZ isomer mixture in a weight ratio of 80:20.

12. The process according to claim 1, wherein (−)-Ambrox is produced in admixture with at least one or more of the by-products (II), (IV) and/or (III)

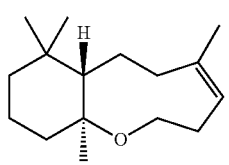
(II)

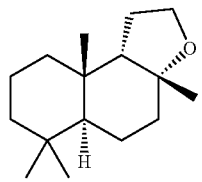
(III)

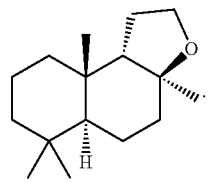
(IV)

13. The process according to claim 1, wherein (−)-Ambrox is isolated from the bioconversion reaction mixture using an organic solvent or a steam extraction/distillation step or filtration.

14. The process according to claim 1, wherein (−)-Ambrox is isolated from the solid phase of the bioconversion reaction mixture using an organic solvent or a steam extraction/distillation step.

15. The process according to claim 14, wherein the (−)-Ambrox is isolated from the reaction mixture using an organic solvent.

16. The process according to claim 15, wherein (−)-Ambrox is isolated from the reaction mixture using ethanol or toluene.

17. The process according to claim 16, wherein the (−)-Ambrox is selectively crystallized using an organic solvent.

18. The process according to claim 17, wherein the (−)-Ambrox is substantially free of the by-products (II), (IV) and/or (III)

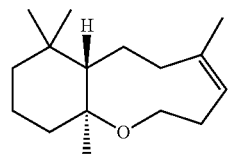
(II)

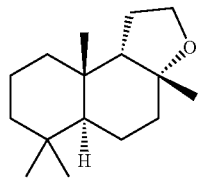
(III)

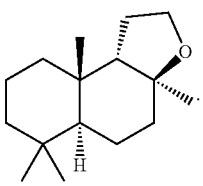
(IV)

19. The process according to claim 1, wherein (−)-Ambrox in a concentration range of about 125-200 g/l is produced.

20. The process according to claim 4, wherein the conversion of homofarnesol to (−)-Ambrox takes place at a pH range of 5.0 to 6.2 and at a temperature of about 35° C.

21. The process according to claim 5, wherein the SDS/cell ratio is 16:1 when the ratio of biocatalyst to EEH is about 2:1.

22. The process according to claim 6, wherein the weight ratio of biocatalyst to homofarnesol is in the range of from about 1:1 or 0.5:1.

23. The process according to claim 2, wherein the process uses SDS with the recombinant host cells producing the SHC/HAC enzyme.

24. The process according to claim 2, wherein in a first step the recombinant cells grow and produce the SHC/HAC enzyme.

25. The process according to claim 24, wherein the cell growth and bioconversion reaction steps are carried out in the same reaction vessel.

* * * * *